United States Patent 11,407,997 (MATERIALS AND METHODS FOR TREATMENT OF PRIMARY HYPEROXALURIA TYPE 1 (PH1) AND OTHER ALANINE-GLYOXYLATE AMINOTRANSFERASE (AGXT) GENE RELATED CONDITIONS OR DISORDERS) - sequence listing, part 2

SEQ ID NO: 7591 - DNA, 20 bp, Artificial Sequence
  Description of Artificial Sequence: Synthetic oligonucleotide
  Target: AGXT; (-) strand; PAM type: NRG; PAM sequence: GAG
aggaggcagtgggctggcag

SEQ ID NO: 7592 - DNA, 20 bp, Artificial Sequence
  Description of Artificial Sequence: Synthetic oligonucleotide
  Target: AGXT; (-) strand; PAM type: NRG; PAM sequence: AGG
ggaggaggcagtgggctggc

SEQ ID NO: 7593 - DNA, 20 bp, Artificial Sequence
  Description of Artificial Sequence: Synthetic oligonucleotide
  Target: AGXT; (-) strand; PAM type: NRG; PAM sequence: CAG
tggaggaggcagtgggctgg

SEQ ID NO: 7594 - DNA, 20 bp, Artificial Sequence
  Description of Artificial Sequence: Synthetic oligonucleotide
  Target: AGXT; (-) strand; PAM type: NRG; PAM sequence: TGG
gcctggaggaggcagtgggc

SEQ ID NO: 7595 - DNA, 20 bp, Artificial Sequence
  Description of Artificial Sequence: Synthetic oligonucleotide
  Target: AGXT; (-) strand; PAM type: NRG; PAM sequence: GGG
caccgcctggaggaggcagt

SEQ ID NO: 7596 - DNA, 20 bp, Artificial Sequence
  Description of Artificial Sequence: Synthetic oligonucleotide
  Target: AGXT; (-) strand; PAM type: NRG; PAM sequence: TGG
acaccgcctggaggaggcag

SEQ ID NO: 7597 - DNA, 20 bp, Artificial Sequence
  Description of Artificial Sequence: Synthetic oligonucleotide
  Target: AGXT; (-) strand; PAM type: NRG; PAM sequence: CAG
ccgacaccgcctggaggagg

SEQ ID NO: 7598 - DNA, 20 bp, Artificial Sequence
  Description of Artificial Sequence: Synthetic oligonucleotide
  Target: AGXT; (-) strand; PAM type: NRG; PAM sequence: AGG
tgcccgacaccgcctggagg

SEQ ID NO: 7599 - DNA, 20 bp, Artificial Sequence
  Description of Artificial Sequence: Synthetic oligonucleotide
  Target: AGXT; (-) strand; PAM type: NRG; PAM sequence: GAG
gtgcccgacaccgcctggag

SEQ ID NO: 7600 - DNA, 20 bp, Artificial Sequence
  Description of Artificial Sequence: Synthetic oligonucleotide
  Target: AGXT; (-) strand; PAM type: NRG; PAM sequence: AGG
gagtgcccgacaccgcctgg

SEQ ID NO: 7601 - DNA, 20 bp, Artificial Sequence
  Description of Artificial Sequence: Synthetic oligonucleotide
  Target: AGXT; (-) strand; PAM type: NRG; PAM sequence: GAG
tgagtgcccgacaccgcctg

SEQ ID NO: 7602 - DNA, 20 bp, Artificial Sequence
  Description of Artificial Sequence: Synthetic oligonucleotide
  Target: AGXT; (-) strand; PAM type: NRG; PAM sequence: TGG
catgagtgcccgacaccgcc

SEQ ID NO: 7603 - DNA, 20 bp, Artificial Sequence
  Description of Artificial Sequence: Synthetic oligonucleotide
  Target: AGXT; (-) strand; PAM type: NRG; PAM sequence: GAG
ctatcagagtcaggcctcat

SEQ ID NO: 7604 - DNA, 20 bp, Artificial Sequence
  Description of Artificial Sequence: Synthetic oligonucleotide
  Target: AGXT; (-) strand; PAM type: NRG; PAM sequence: AGG
ctcccagccctatcagagtc

SEQ ID NO: 7605 - DNA, 20 bp, Artificial Sequence
  Description of Artificial Sequence: Synthetic oligonucleotide
  Target: AGXT; (-) strand; PAM type: NRG; PAM sequence: CAG
gctcccagccctatcagagt

SEQ ID NO: 7606 - DNA, 20 bp, Artificial Sequence
  Description of Artificial Sequence: Synthetic oligonucleotide
  Target: AGXT; (-) strand; PAM type: NRG; PAM sequence: GAG
tgctgctcccagccctatca

SEQ ID NO: 7607 - DNA, 20 bp, Artificial Sequence
  Description of Artificial Sequence: Synthetic oligonucleotide
  Target: AGXT; (-) strand; PAM type: NRG; PAM sequence: CAG
tgtgctgctcccagccctat

SEQ ID NO: 7608 - DNA, 20 bp, Artificial Sequence
  Description of Artificial Sequence: Synthetic oligonucleotide
  Target: AGXT; (-) strand; PAM type: NRG; PAM sequence: CAG
cggggcacctgtgctgctcc

SEQ ID NO: 7609 - DNA, 20 bp, Artificial Sequence
  Description of Artificial Sequence: Synthetic oligonucleotide
  Target: AGXT; (-) strand; PAM type: NRG; PAM sequence: GGG
caaggagactggggggatcg

SEQ ID NO: 7610 - DNA, 20 bp, Artificial Sequence
  Description of Artificial Sequence: Synthetic oligonucleotide
  Target: AGXT; (-) strand; PAM type: NRG; PAM sequence: GGG
tcaaggagactggggggatc

SEQ ID NO: 7611 - DNA, 20 bp, Artificial Sequence
  Description of Artificial Sequence: Synthetic oligonucleotide
  Target: AGXT; (-) strand; PAM type: NRG; PAM sequence: CGG
ctcaaggagactggggggat

SEQ ID NO: 7612 - DNA, 20 bp, Artificial Sequence
  Description of Artificial Sequence: Synthetic oligonucleotide
  Target: AGXT; (-) strand; PAM type: NRG; PAM sequence: GGG
aacagctcaaggagactggg

SEQ ID NO: 7613 - DNA, 20 bp, Artificial Sequence
  Description of Artificial Sequence: Synthetic oligonucleotide
  Target: AGXT; (-) strand; PAM type: NRG; PAM sequence: GGG
aaacagctcaaggagactgg

SEQ ID NO: 7614 - DNA, 20 bp, Artificial Sequence
  Description of Artificial Sequence: Synthetic oligonucleotide
  Target: AGXT; (-) strand; PAM type: NRG; PAM sequence: GGG
gaaacagctcaaggagactg

SEQ ID NO: 7615 - DNA, 20 bp, Artificial Sequence
  Description of Artificial Sequence: Synthetic oligonucleotide
  Target: AGXT; (-) strand; PAM type: NRG; PAM sequence: GGG
agaaacagctcaaggagact

SEQ ID NO: 7616 - DNA, 20 bp, Artificial Sequence
  Description of Artificial Sequence: Synthetic oligonucleotide
  Target: AGXT; (-) strand; PAM type: NRG; PAM sequence: TGG
cagaaacagctcaaggagac

SEQ ID NO: 7617 - DNA, 20 bp, Artificial Sequence
  Description of Artificial Sequence: Synthetic oligonucleotide
  Target: AGXT; (-) strand; PAM type: NRG; PAM sequence: GAG
tgctccagaaacagctcaag

SEQ ID NO: 7618 - DNA, 20 bp, Artificial Sequence
  Description of Artificial Sequence: Synthetic oligonucleotide
  Target: AGXT; (-) strand; PAM type: NRG; PAM sequence: AGG
catgctccagaaacagctca

SEQ ID NO: 7619 - DNA, 20 bp, Artificial Sequence
  Description of Artificial Sequence: Synthetic oligonucleotide
  Target: AGXT; (-) strand; PAM type: NRG; PAM sequence: AAG
acatgctccagaaacagctc

SEQ ID NO: 7620 - DNA, 20 bp, Artificial Sequence
  Description of Artificial Sequence: Synthetic oligonucleotide
  Target: AGXT; (-) strand; PAM type: NRG; PAM sequence: CAG
tcctgcacatgctccagaaa

SEQ ID NO: 7621 - DNA, 20 bp, Artificial Sequence
  Description of Artificial Sequence: Synthetic oligonucleotide
  Target: AGXT; (-) strand; PAM type: NRG; PAM sequence: CAG
gttccgtcctgcacatgctc

SEQ ID NO: 7622 - DNA, 20 bp, Artificial Sequence
  Description of Artificial Sequence: Synthetic oligonucleotide
  Target: AGXT; (-) strand; PAM type: NRG; PAM sequence: TAG
tgggaccagaggcttccctg

SEQ ID NO: 7623 - DNA, 20 bp, Artificial Sequence
  Description of Artificial Sequence: Synthetic oligonucleotide
  Target: AGXT; (-) strand; PAM type: NRG; PAM sequence: AGG
ggagtgtgtgctgggaccag

SEQ ID NO: 7624 - DNA, 20 bp, Artificial Sequence
  Description of Artificial Sequence: Synthetic oligonucleotide
  Target: AGXT; (-) strand; PAM type: NRG; PAM sequence: GAG
aggagtgtgtgctgggacca

SEQ ID NO: 7625 - DNA, 20 bp, Artificial Sequence
  Description of Artificial Sequence: Synthetic oligonucleotide
  Target: AGXT; (-) strand; PAM type: NRG; PAM sequence: CAG
tcaggagtgtgtgctgggac

SEQ ID NO: 7626 - DNA, 20 bp, Artificial Sequence
  Description of Artificial Sequence: Synthetic oligonucleotide
  Target: AGXT; (-) strand; PAM type: NRG; PAM sequence: GGG
ggctctcaggagtgtgtgct

SEQ ID NO: 7627 - DNA, 20 bp, Artificial Sequence
  Description of Artificial Sequence: Synthetic oligonucleotide
  Target: AGXT; (-) strand; PAM type: NRG; PAM sequence: TGG
gggctctcaggagtgtgtgc

SEQ ID NO: 7628 - DNA, 20 bp, Artificial Sequence
  Description of Artificial Sequence: Synthetic oligonucleotide
  Target: AGXT; (-) strand; PAM type: NRG; PAM sequence: GAG
acagcggccggggctctcag

SEQ ID NO: 7629 - DNA, 20 bp, Artificial Sequence
  Description of Artificial Sequence: Synthetic oligonucleotide
  Target: AGXT; (-) strand; PAM type: NRG; PAM sequence: AGG
ggacagcggccggggctctc

SEQ ID NO: 7630 - DNA, 20 bp, Artificial Sequence
  Description of Artificial Sequence: Synthetic oligonucleotide
  Target: AGXT; (-) strand; PAM type: NRG; PAM sequence: CAG
tggacagcggccggggctct

SEQ ID NO: 7631 - DNA, 20 bp, Artificial Sequence
  Description of Artificial Sequence: Synthetic oligonucleotide
  Target: AGXT; (-) strand; PAM type: NRG; PAM sequence: GGG
ggggccctggacagcggccg

SEQ ID NO: 7632 - DNA, 20 bp, Artificial Sequence
  Description of Artificial Sequence: Synthetic oligonucleotide
  Target: AGXT; (-) strand; PAM type: NRG; PAM sequence: GGG
tggggccctggacagcggcc

SEQ ID NO: 7633 - DNA, 20 bp, Artificial Sequence
  Description of Artificial Sequence: Synthetic oligonucleotide
  Target: AGXT; (-) strand; PAM type: NRG; PAM sequence: CGG
ctggggccctggacagcggc

SEQ ID NO: 7634 - DNA, 20 bp, Artificial Sequence
  Description of Artificial Sequence: Synthetic oligonucleotide
  Target: AGXT; (-) strand; PAM type: NRG; PAM sequence: CGG
gtgcctggggccctggacag

SEQ ID NO: 7635 - DNA, 20 bp, Artificial Sequence
  Description of Artificial Sequence: Synthetic oligonucleotide
  Target: AGXT; (-) strand; PAM type: NRG; PAM sequence: CAG
ctggtgcctggggccctgga

SEQ ID NO: 7636 - DNA, 20 bp, Artificial Sequence
  Description of Artificial Sequence: Synthetic oligonucleotide
  Target: AGXT; (-) strand; PAM type: NRG; PAM sequence: TGG
agagctggtgcctggggccc

SEQ ID NO: 7637 - DNA, 20 bp, Artificial Sequence
  Description of Artificial Sequence: Synthetic oligonucleotide
  Target: AGXT; (-) strand; PAM type: NRG; PAM sequence: GGG
caaagcagagctggtgcctg

SEQ ID NO: 7638 - DNA, 20 bp, Artificial Sequence
  Description of Artificial Sequence: Synthetic oligonucleotide
  Target: AGXT; (-) strand; PAM type: NRG; PAM sequence: GGG
acaaagcagagctggtgcct

SEQ ID NO: 7639 - DNA, 20 bp, Artificial Sequence
  Description of Artificial Sequence: Synthetic oligonucleotide
  Target: AGXT; (-) strand; PAM type: NRG; PAM sequence: TGG
cacaaagcagagctggtgcc

SEQ ID NO: 7640 - DNA, 20 bp, Artificial Sequence
  Description of Artificial Sequence: Synthetic oligonucleotide
  Target: AGXT; (-) strand; PAM type: NRG; PAM sequence: TGG
accctgtcacaaagcagagc

SEQ ID NO: 7641 - DNA, 20 bp, Artificial Sequence
  Description of Artificial Sequence: Synthetic oligonucleotide
  Target: AGXT; (-) strand; PAM type: NRG; PAM sequence: GAG
ccccaccctgtcacaaagca

SEQ ID NO: 7642 - DNA, 20 bp, Artificial Sequence
  Description of Artificial Sequence: Synthetic oligonucleotide
  Target: AGXT; (-) strand; PAM type: NRG; PAM sequence: CAG
aaccccaccctgtcacaaag

SEQ ID NO: 7643 - DNA, 20 bp, Artificial Sequence
  Description of Artificial Sequence: Synthetic oligonucleotide
  Target: AGXT; (-) strand; PAM type: NRG; PAM sequence: AAG
tgaaaccccaccctgtcaca

SEQ ID NO: 7644 - DNA, 20 bp, Artificial Sequence
  Description of Artificial Sequence: Synthetic oligonucleotide
  Target: AGXT; (-) strand; PAM type: NRG; PAM sequence: CAG
tgagatttgaggggaggctt

SEQ ID NO: 7645 - DNA, 20 bp, Artificial Sequence
  Description of Artificial Sequence: Synthetic oligonucleotide
  Target: AGXT; (-) strand; PAM type: NRG; PAM sequence: AGG
ggctgctgagatttgagggg

SEQ ID NO: 7646 - DNA, 20 bp, Artificial Sequence
  Description of Artificial Sequence: Synthetic oligonucleotide
  Target: AGXT; (-) strand; PAM type: NRG; PAM sequence: GAG
aggctgctgagatttgaggg

SEQ ID NO: 7647 - DNA, 20 bp, Artificial Sequence
  Description of Artificial Sequence: Synthetic oligonucleotide
  Target: AGXT; (-) strand; PAM type: NRG; PAM sequence: GGG
gaaggctgctgagatttgag

SEQ ID NO: 7648 - DNA, 20 bp, Artificial Sequence
  Description of Artificial Sequence: Synthetic oligonucleotide
  Target: AGXT; (-) strand; PAM type: NRG; PAM sequence: GGG
ggaaggctgctgagatttga

SEQ ID NO: 7649 - DNA, 20 bp, Artificial Sequence
  Description of Artificial Sequence: Synthetic oligonucleotide
  Target: AGXT; (-) strand; PAM type: NRG; PAM sequence: AGG
aggaaggctgctgagatttg

SEQ ID NO: 7650 - DNA, 20 bp, Artificial Sequence
  Description of Artificial Sequence: Synthetic oligonucleotide
  Target: AGXT; (-) strand; PAM type: NRG; PAM sequence: GAG
aaggaaggctgctgagattt

SEQ ID NO: 7651 - DNA, 20 bp, Artificial Sequence
  Description of Artificial Sequence: Synthetic oligonucleotide
  Target: AGXT; (-) strand; PAM type: NRG; PAM sequence: GAG
attccagaaggaaggctgct

SEQ ID NO: 7652 - DNA, 20 bp, Artificial Sequence
  Description of Artificial Sequence: Synthetic oligonucleotide
  Target: AGXT; (-) strand; PAM type: NRG; PAM sequence: AGG
acatcaagattccagaagga

SEQ ID NO: 7653 - DNA, 20 bp, Artificial Sequence
  Description of Artificial Sequence: Synthetic oligonucleotide
  Target: AGXT; (-) strand; PAM type: NRG; PAM sequence: AAG
cacatcaagattccagaagg

SEQ ID NO: 7654 - DNA, 20 bp, Artificial Sequence
  Description of Artificial Sequence: Synthetic oligonucleotide
  Target: AGXT; (-) strand; PAM type: NRG; PAM sequence: AGG
tatcacatcaagattccaga

SEQ ID NO: 7655 - DNA, 20 bp, Artificial Sequence
  Description of Artificial Sequence: Synthetic oligonucleotide
  Target: AGXT; (-) strand; PAM type: NRG; PAM sequence: AAG
gtatcacatcaagattccag

SEQ ID NO: 7656 - DNA, 20 bp, Artificial Sequence
  Description of Artificial Sequence: Synthetic oligonucleotide
  Target: AGXT; (-) strand; PAM type: NRG; PAM sequence: CAG
tgtgtatcacatcaagattc

SEQ ID NO: 7657 - DNA, 20 bp, Artificial Sequence
  Description of Artificial Sequence: Synthetic oligonucleotide
  Target: AGXT; (-) strand; PAM type: NRG; PAM sequence: AAG
catattttgtgtatcacatc

SEQ ID NO: 7658 - DNA, 20 bp, Artificial Sequence
  Description of Artificial Sequence: Synthetic oligonucleotide
  Target: AGXT; (-) strand; PAM type: NRG; PAM sequence: AGG
cccagaaaagtgtactccgg

SEQ ID NO: 7659 - DNA, 20 bp, Artificial Sequence
  Description of Artificial Sequence: Synthetic oligonucleotide
  Target: AGXT; (-) strand; PAM type: NRG; PAM sequence: GAG
tcccagaaaagtgtactccg

SEQ ID NO: 7660 - DNA, 20 bp, Artificial Sequence
  Description of Artificial Sequence: Synthetic oligonucleotide
  Target: AGXT; (-) strand; PAM type: NRG; PAM sequence: CGG
tctcccagaaaagtgtactc

SEQ ID NO: 7661 - DNA, 20 bp, Artificial Sequence
  Description of Artificial Sequence: Synthetic oligonucleotide
  Target: AGXT; (-) strand; PAM type: NRG; PAM sequence: AAG
ctcctgtgtctctcccagaa

SEQ ID NO: 7662 - DNA, 20 bp, Artificial Sequence
  Description of Artificial Sequence: Synthetic oligonucleotide
  Target: AGXT; (-) strand; PAM type: NRG; PAM sequence: CAG
tcctgctcctgtgtctctcc

SEQ ID NO: 7663 - DNA, 20 bp, Artificial Sequence
  Description of Artificial Sequence: Synthetic oligonucleotide
  Target: AGXT; (-) strand; PAM type: NRG; PAM sequence: GGG
acaatcaatcattaaaccca

SEQ ID NO: 7664 - DNA, 20 bp, Artificial Sequence
  Description of Artificial Sequence: Synthetic oligonucleotide
  Target: AGXT; (-) strand; PAM type: NRG; PAM sequence: AGG
cacaatcaatcattaaaccc

SEQ ID NO: 7665 - DNA, 20 bp, Artificial Sequence
  Description of Artificial Sequence: Synthetic oligonucleotide
  Target: AGXT; (-) strand; PAM type: NRG; PAM sequence: CAG
ccacaatcaatcattaaacc

SEQ ID NO: 7666 - DNA, 20 bp, Artificial Sequence
  Description of Artificial Sequence: Synthetic oligonucleotide
  Target: AGXT; (-) strand; PAM type: NRG; PAM sequence: AAG
tggccattgtggagctcacc

SEQ ID NO: 7667 - DNA, 20 bp, Artificial Sequence
  Description of Artificial Sequence: Synthetic oligonucleotide
  Target: AGXT; (-) strand; PAM type: NRG; PAM sequence: GAG
taaccagcatggccattgtg

SEQ ID NO: 7668 - DNA, 20 bp, Artificial Sequence
  Description of Artificial Sequence: Synthetic oligonucleotide
  Target: AGXT; (-) strand; PAM type: NRG; PAM sequence: TGG
attaaccagcatggccattg

SEQ ID NO: 7669 - DNA, 20 bp, Artificial Sequence
  Description of Artificial Sequence: Synthetic oligonucleotide
  Target: AGXT; (-) strand; PAM type: NRG; PAM sequence: TGG
cggtcgcgtattaaccagca

SEQ ID NO: 7670 - DNA, 20 bp, Artificial Sequence
  Description of Artificial Sequence: Synthetic oligonucleotide
  Target: AGXT; (-) strand; PAM type: NRG; PAM sequence: CAG
tgttgcggtcgcgtattaac

SEQ ID NO: 7671 - DNA, 20 bp, Artificial Sequence
  Description of Artificial Sequence: Synthetic oligonucleotide
  Target: AGXT; (-) strand; PAM type: NRG; PAM sequence: CGG
tgggaccctcttggctgttg

SEQ ID NO: 7672 - DNA, 20 bp, Artificial Sequence
  Description of Artificial Sequence: Synthetic oligonucleotide
  Target: AGXT; (-) strand; PAM type: NRG; PAM sequence: TGG
acttggggttgggaccctct

SEQ ID NO: 7673 - DNA, 20 bp, Artificial Sequence
  Description of Artificial Sequence: Synthetic oligonucleotide
  Target: AGXT; (-) strand; PAM type: NRG; PAM sequence: GGG
aagtttgtggacttggggtt

SEQ ID NO: 7674 - DNA, 20 bp, Artificial Sequence
  Description of Artificial Sequence: Synthetic oligonucleotide
  Target: AGXT; (-) strand; PAM type: NRG; PAM sequence: TGG
aaagtttgtggacttggggt

SEQ ID NO: 7675 - DNA, 20 bp, Artificial Sequence
  Description of Artificial Sequence: Synthetic oligonucleotide
  Target: AGXT; (-) strand; PAM type: NRG; PAM sequence: GGG
ttgaaaagtttgtggacttg

SEQ ID NO: 7676 - DNA, 20 bp, Artificial Sequence
  Description of Artificial Sequence: Synthetic oligonucleotide
  Target: AGXT; (-) strand; PAM type: NRG; PAM sequence: GGG
cttgaaaagtttgtggactt

SEQ ID NO: 7677 - DNA, 20 bp, Artificial Sequence
  Description of Artificial Sequence: Synthetic oligonucleotide
  Target: AGXT; (-) strand; PAM type: NRG; PAM sequence: TGG
ccttgaaaagtttgtggact

SEQ ID NO: 7678 - DNA, 20 bp, Artificial Sequence
  Description of Artificial Sequence: Synthetic oligonucleotide
  Target: AGXT; (-) strand; PAM type: NRG; PAM sequence: TGG
gggtccccttgaaaagtttg

SEQ ID NO: 7679 - DNA, 20 bp, Artificial Sequence
  Description of Artificial Sequence: Synthetic oligonucleotide
  Target: AGXT; (-) strand; PAM type: NRG; PAM sequence: AAG
cgaccctgggtccccttgaa

SEQ ID NO: 7680 - DNA, 20 bp, Artificial Sequence
  Description of Artificial Sequence: Synthetic oligonucleotide
  Target: AGXT; (-) strand; PAM type: NRG; PAM sequence: GGG
tcctggcctctgccgaccct

SEQ ID NO: 7681 - DNA, 20 bp, Artificial Sequence
  Description of Artificial Sequence: Synthetic oligonucleotide
  Target: AGXT; (-) strand; PAM type: NRG; PAM sequence: TGG
gtcctggcctctgccgaccc

SEQ ID NO: 7682 - DNA, 20 bp, Artificial Sequence
  Description of Artificial Sequence: Synthetic oligonucleotide
  Target: AGXT; (-) strand; PAM type: NRG; PAM sequence: TGG
ctgatgtccacttggggtcc

SEQ ID NO: 7683 - DNA, 20 bp, Artificial Sequence
  Description of Artificial Sequence: Synthetic oligonucleotide
  Target: AGXT; (-) strand; PAM type: NRG; PAM sequence: GGG
cgtgccctgatgtccacttg

SEQ ID NO: 7684 - DNA, 20 bp, Artificial Sequence
  Description of Artificial Sequence: Synthetic oligonucleotide
  Target: AGXT; (-) strand; PAM type: NRG; PAM sequence: GGG
gcgtgccctgatgtccactt

SEQ ID NO: 7685 - DNA, 20 bp, Artificial Sequence
  Description of Artificial Sequence: Synthetic oligonucleotide
  Target: AGXT; (-) strand; PAM type: NRG; PAM sequence: TGG
tgcgtgccctgatgtccact

SEQ ID NO: 7686 - DNA, 20 bp, Artificial Sequence
  Description of Artificial Sequence: Synthetic oligonucleotide
  Target: AGXT; (-) strand; PAM type: NRG; PAM sequence: GAG
gccatataccacaggcatct

SEQ ID NO: 7687 - DNA, 20 bp, Artificial Sequence
  Description of Artificial Sequence: Synthetic oligonucleotide
  Target: AGXT; (-) strand; PAM type: NRG; PAM sequence: AGG
aaagggaagccatataccac

SEQ ID NO: 7688 - DNA, 20 bp, Artificial Sequence
  Description of Artificial Sequence: Synthetic oligonucleotide
  Target: AGXT; (-) strand; PAM type: NRG; PAM sequence: CAG
aaaagggaagccatatacca

SEQ ID NO: 7689 - DNA, 20 bp, Artificial Sequence
  Description of Artificial Sequence: Synthetic oligonucleotide
  Target: AGXT; (-) strand; PAM type: NRG; PAM sequence: AAG
ggacagaatggggaaaaggg

SEQ ID NO: 7690 - DNA, 20 bp, Artificial Sequence
  Description of Artificial Sequence: Synthetic oligonucleotide
  Target: AGXT; (-) strand; PAM type: NRG; PAM sequence: GGG
aggggacagaatggggaaaa

SEQ ID NO: 7691 - DNA, 20 bp, Artificial Sequence
  Description of Artificial Sequence: Synthetic oligonucleotide
  Target: AGXT; (-) strand; PAM type: NRG; PAM sequence: AGG
aaggggacagaatggggaaa

SEQ ID NO: 7692 - DNA, 20 bp, Artificial Sequence
  Description of Artificial Sequence: Synthetic oligonucleotide
  Target: AGXT; (-) strand; PAM type: NRG; PAM sequence: AAG
caaggggacagaatggggaa

SEQ ID NO: 7693 - DNA, 20 bp, Artificial Sequence
  Description of Artificial Sequence: Synthetic oligonucleotide
  Target: AGXT; (-) strand; PAM type: NRG; PAM sequence: GGG
gcggccaaggggacagaatg

SEQ ID NO: 7694 - DNA, 20 bp, Artificial Sequence
  Description of Artificial Sequence: Synthetic oligonucleotide
  Target: AGXT; (-) strand; PAM type: NRG; PAM sequence: GGG
tgcggccaaggggacagaat

SEQ ID NO: 7695 - DNA, 20 bp, Artificial Sequence
  Description of Artificial Sequence: Synthetic oligonucleotide
  Target: AGXT; (-) strand; PAM type: NRG; PAM sequence: TGG
ctgcggccaaggggacagaa

SEQ ID NO: 7696 - DNA, 20 bp, Artificial Sequence
  Description of Artificial Sequence: Synthetic oligonucleotide
  Target: AGXT; (-) strand; PAM type: NRG; PAM sequence: CAG
agaacctgcggccaagggga

SEQ ID NO: 7697 - DNA, 20 bp, Artificial Sequence
  Description of Artificial Sequence: Synthetic oligonucleotide
  Target: AGXT; (-) strand; PAM type: NRG; PAM sequence: GGG
gggaagaacctgcggccaag

SEQ ID NO: 7698 - DNA, 20 bp, Artificial Sequence
  Description of Artificial Sequence: Synthetic oligonucleotide
  Target: AGXT; (-) strand; PAM type: NRG; PAM sequence: GGG
ggggaagaacctgcggccaa

SEQ ID NO: 7699 - DNA, 20 bp, Artificial Sequence
  Description of Artificial Sequence: Synthetic oligonucleotide
  Target: AGXT; (-) strand; PAM type: NRG; PAM sequence: AGG
aggggaagaacctgcggcca

SEQ ID NO: 7700 - DNA, 20 bp, Artificial Sequence
  Description of Artificial Sequence: Synthetic oligonucleotide
  Target: AGXT; (-) strand; PAM type: NRG; PAM sequence: AAG
gaggggaagaacctgcggcc

SEQ ID NO: 7701 - DNA, 20 bp, Artificial Sequence
  Description of Artificial Sequence: Synthetic oligonucleotide
  Target: AGXT; (-) strand; PAM type: NRG; PAM sequence: CGG
tgtgggaggggaagaacctg

SEQ ID NO: 7702 - DNA, 20 bp, Artificial Sequence
  Description of Artificial Sequence: Synthetic oligonucleotide
  Target: AGXT; (-) strand; PAM type: NRG; PAM sequence: AAG
gggccaggttgtgggagggg

SEQ ID NO: 7703 - DNA, 20 bp, Artificial Sequence
  Description of Artificial Sequence: Synthetic oligonucleotide
  Target: AGXT; (-) strand; PAM type: NRG; PAM sequence: GGG
tcagggccaggttgtgggag

SEQ ID NO: 7704 - DNA, 20 bp, Artificial Sequence
  Description of Artificial Sequence: Synthetic oligonucleotide
  Target: AGXT; (-) strand; PAM type: NRG; PAM sequence: GGG
ttcagggccaggttgtggga

SEQ ID NO: 7705 - DNA, 20 bp, Artificial Sequence
  Description of Artificial Sequence: Synthetic oligonucleotide
  Target: AGXT; (-) strand; PAM type: NRG; PAM sequence: AGG
gttcagggccaggttgtggg

SEQ ID NO: 7706 - DNA, 20 bp, Artificial Sequence
  Description of Artificial Sequence: Synthetic oligonucleotide
  Target: AGXT; (-) strand; PAM type: NRG; PAM sequence: GAG
tgttcagggccaggttgtgg

SEQ ID NO: 7707 - DNA, 20 bp, Artificial Sequence
  Description of Artificial Sequence: Synthetic oligonucleotide
  Target: AGXT; (-) strand; PAM type: NRG; PAM sequence: GGG
gctgttcagggccaggttgt

SEQ ID NO: 7708 - DNA, 20 bp, Artificial Sequence
  Description of Artificial Sequence: Synthetic oligonucleotide
  Target: AGXT; (-) strand; PAM type: NRG; PAM sequence: TGG
tgctgttcagggccaggttg

SEQ ID NO: 7709 - DNA, 20 bp, Artificial Sequence
  Description of Artificial Sequence: Synthetic oligonucleotide
  Target: AGXT; (-) strand; PAM type: NRG; PAM sequence: AGG
cctgtgtgctgttcagggcc

SEQ ID NO: 7710 - DNA, 20 bp, Artificial Sequence
  Description of Artificial Sequence: Synthetic oligonucleotide
  Target: AGXT; (-) strand; PAM type: NRG; PAM sequence: CAG
tcctgtgtgctgttcagggc

SEQ ID NO: 7711 - DNA, 20 bp, Artificial Sequence
  Description of Artificial Sequence: Synthetic oligonucleotide
  Target: AGXT; (-) strand; PAM type: NRG; PAM sequence: GGG
cctatcctgtgtgctgttca

SEQ ID NO: 7712 - DNA, 20 bp, Artificial Sequence
  Description of Artificial Sequence: Synthetic oligonucleotide
  Target: AGXT; (-) strand; PAM type: NRG; PAM sequence: AGG
ccctatcctgtgtgctgttc

SEQ ID NO: 7713 - DNA, 20 bp, Artificial Sequence
  Description of Artificial Sequence: Synthetic oligonucleotide
  Target: AGXT; (-) strand; PAM type: NRG; PAM sequence: CAG
gccctatcctgtgtgctgtt

SEQ ID NO: 7714 - DNA, 20 bp, Artificial Sequence
  Description of Artificial Sequence: Synthetic oligonucleotide
  Target: AGXT; (-) strand; PAM type: NRG; PAM sequence: AGG
agctggggactccaggaatc

SEQ ID NO: 7715 - DNA, 20 bp, Artificial Sequence
  Description of Artificial Sequence: Synthetic oligonucleotide
  Target: AGXT; (-) strand; PAM type: NRG; PAM sequence: CAG
gagctggggactccaggaat

SEQ ID NO: 7716 - DNA, 20 bp, Artificial Sequence
  Description of Artificial Sequence: Synthetic oligonucleotide
  Target: AGXT; (-) strand; PAM type: NRG; PAM sequence: AGG
ctgttggagctggggactcc

SEQ ID NO: 7717 - DNA, 20 bp, Artificial Sequence
  Description of Artificial Sequence: Synthetic oligonucleotide
  Target: AGXT; (-) strand; PAM type: NRG; PAM sequence: CAG
tctgttggagctggggactc

SEQ ID NO: 7718 - DNA, 20 bp, Artificial Sequence
  Description of Artificial Sequence: Synthetic oligonucleotide
  Target: AGXT; (-) strand; PAM type: NRG; PAM sequence: GGG
cttgacctctgttggagctg

SEQ ID NO: 7719 - DNA, 20 bp, Artificial Sequence
  Description of Artificial Sequence: Synthetic oligonucleotide
  Target: AGXT; (-) strand; PAM type: NRG; PAM sequence: GGG
ccttgacctctgttggagct

SEQ ID NO: 7720 - DNA, 20 bp, Artificial Sequence
  Description of Artificial Sequence: Synthetic oligonucleotide
  Target: AGXT; (-) strand; PAM type: NRG; PAM sequence: TGG
gccttgacctctgttggagc

SEQ ID NO: 7721 - DNA, 20 bp, Artificial Sequence
  Description of Artificial Sequence: Synthetic oligonucleotide
  Target: AGXT; (-) strand; PAM type: NRG; PAM sequence: GAG
agcagccttgacctctgttg

SEQ ID NO: 7722 - DNA, 20 bp, Artificial Sequence
  Description of Artificial Sequence: Synthetic oligonucleotide
  Target: AGXT; (-) strand; PAM type: NRG; PAM sequence: TGG
gcagcagccttgacctctgt

SEQ ID NO: 7723 - DNA, 20 bp, Artificial Sequence
  Description of Artificial Sequence: Synthetic oligonucleotide
  Target: AGXT; (-) strand; PAM type: NRG; PAM sequence: CAG
atgaggggtgagtgaggcag

SEQ ID NO: 7724 - DNA, 20 bp, Artificial Sequence
  Description of Artificial Sequence: Synthetic oligonucleotide
  Target: AGXT; (-) strand; PAM type: NRG; PAM sequence: CAG
aggatgaggggtgagtgagg

SEQ ID NO: 7725 - DNA, 20 bp, Artificial Sequence
  Description of Artificial Sequence: Synthetic oligonucleotide
  Target: AGXT; (-) strand; PAM type: NRG; PAM sequence: AGG
tgaaggatgaggggtgagtg

SEQ ID NO: 7726 - DNA, 20 bp, Artificial Sequence
  Description of Artificial Sequence: Synthetic oligonucleotide
  Target: AGXT; (-) strand; PAM type: NRG; PAM sequence: GAG
ctgaaggatgaggggtgagt

SEQ ID NO: 7727 - DNA, 20 bp, Artificial Sequence
  Description of Artificial Sequence: Synthetic oligonucleotide
  Target: AGXT; (-) strand; PAM type: NRG; PAM sequence: GAG
cagactgaaggatgaggggt

SEQ ID NO: 7728 - DNA, 20 bp, Artificial Sequence
  Description of Artificial Sequence: Synthetic oligonucleotide
  Target: AGXT; (-) strand; PAM type: NRG; PAM sequence: GGG
atgacagactgaaggatgag

SEQ ID NO: 7729 - DNA, 20 bp, Artificial Sequence
  Description of Artificial Sequence: Synthetic oligonucleotide
  Target: AGXT; (-) strand; PAM type: NRG; PAM sequence: GGG
gatgacagactgaaggatga

SEQ ID NO: 7730 - DNA, 20 bp, Artificial Sequence
  Description of Artificial Sequence: Synthetic oligonucleotide
  Target: AGXT; (-) strand; PAM type: NRG; PAM sequence: AGG
ggatgacagactgaaggatg

SEQ ID NO: 7731 - DNA, 20 bp, Artificial Sequence
  Description of Artificial Sequence: Synthetic oligonucleotide
  Target: AGXT; (-) strand; PAM type: NRG; PAM sequence: GAG
tggatgacagactgaaggat

SEQ ID NO: 7732 - DNA, 20 bp, Artificial Sequence
  Description of Artificial Sequence: Synthetic oligonucleotide
  Target: AGXT; (-) strand; PAM type: NRG; PAM sequence: AGG
tgtgatggatgacagactga

SEQ ID NO: 7733 - DNA, 20 bp, Artificial Sequence
  Description of Artificial Sequence: Synthetic oligonucleotide
  Target: AGXT; (-) strand; PAM type: NRG; PAM sequence: AAG
gtgtgatggatgacagactg

SEQ ID NO: 7734 - DNA, 20 bp, Artificial Sequence
  Description of Artificial Sequence: Synthetic oligonucleotide
  Target: AGXT; (-) strand; PAM type: NRG; PAM sequence: CAG
accacaggtgtgatggatga

SEQ ID NO: 7735 - DNA, 20 bp, Artificial Sequence
  Description of Artificial Sequence: Synthetic oligonucleotide
  Target: AGXT; (-) strand; PAM type: NRG; PAM sequence: TGG
ctggcacaccacaggtgtga

SEQ ID NO: 7736 - DNA, 20 bp, Artificial Sequence
  Description of Artificial Sequence: Synthetic oligonucleotide
  Target: AGXT; (-) strand; PAM type: NRG; PAM sequence: AGG
gtccagggctggcacaccac

SEQ ID NO: 7737 - DNA, 20 bp, Artificial Sequence
  Description of Artificial Sequence: Synthetic oligonucleotide
  Target: AGXT; (-) strand; PAM type: NRG; PAM sequence: CAG
ggtccagggctggcacacca

SEQ ID NO: 7738 - DNA, 20 bp, Artificial Sequence
  Description of Artificial Sequence: Synthetic oligonucleotide
  Target: AGXT; (-) strand; PAM type: NRG; PAM sequence: TGG
gagtgtacctggtccagggc

SEQ ID NO: 7739 - DNA, 20 bp, Artificial Sequence
  Description of Artificial Sequence: Synthetic oligonucleotide
  Target: AGXT; (-) strand; PAM type: NRG; PAM sequence: GGG
caaagagtgtacctggtcca

SEQ ID NO: 7740 - DNA, 20 bp, Artificial Sequence
  Description of Artificial Sequence: Synthetic oligonucleotide
  Target: AGXT; (-) strand; PAM type: NRG; PAM sequence: AGG
acaaagagtgtacctggtcc

SEQ ID NO: 7741 - DNA, 20 bp, Artificial Sequence
  Description of Artificial Sequence: Synthetic oligonucleotide
  Target: AGXT; (-) strand; PAM type: NRG; PAM sequence: CAG
cacaaagagtgtacctggtc

SEQ ID NO: 7742 - DNA, 20 bp, Artificial Sequence
  Description of Artificial Sequence: Synthetic oligonucleotide
  Target: AGXT; (-) strand; PAM type: NRG; PAM sequence: TGG
gctggcacaaagagtgtacc

SEQ ID NO: 7743 - DNA, 20 bp, Artificial Sequence
  Description of Artificial Sequence: Synthetic oligonucleotide
  Target: AGXT; (-) strand; PAM type: NRG; PAM sequence: GAG
tggcccagggctggcacaaa

SEQ ID NO: 7744 - DNA, 20 bp, Artificial Sequence
  Description of Artificial Sequence: Synthetic oligonucleotide
  Target: AGXT; (-) strand; PAM type: NRG; PAM sequence: AAG
cctggcccagggctggcaca

SEQ ID NO: 7745 - DNA, 20 bp, Artificial Sequence
  Description of Artificial Sequence: Synthetic oligonucleotide
  Target: AGXT; (-) strand; PAM type: NRG; PAM sequence: TGG
ggctgcacctggcccagggc

SEQ ID NO: 7746 - DNA, 20 bp, Artificial Sequence
  Description of Artificial Sequence: Synthetic oligonucleotide
  Target: AGXT; (-) strand; PAM type: NRG; PAM sequence: GGG
tcagggctgcacctggccca

SEQ ID NO: 7747 - DNA, 20 bp, Artificial Sequence
  Description of Artificial Sequence: Synthetic oligonucleotide
  Target: AGXT; (-) strand; PAM type: NRG; PAM sequence: AGG
gtcagggctgcacctggccc

SEQ ID NO: 7748 - DNA, 20 bp, Artificial Sequence
  Description of Artificial Sequence: Synthetic oligonucleotide
  Target: AGXT; (-) strand; PAM type: NRG; PAM sequence: CAG
agtcagggctgcacctggcc

SEQ ID NO: 7749 - DNA, 20 bp, Artificial Sequence
  Description of Artificial Sequence: Synthetic oligonucleotide
  Target: AGXT; (-) strand; PAM type: NRG; PAM sequence: TGG
ccgggagtcagggctgcacc

SEQ ID NO: 7750 - DNA, 20 bp, Artificial Sequence
  Description of Artificial Sequence: Synthetic oligonucleotide
  Target: AGXT; (-) strand; PAM type: NRG; PAM sequence: GGG
gagtgagctcccgggagtca

SEQ ID NO: 7751 - DNA, 20 bp, Artificial Sequence
  Description of Artificial Sequence: Synthetic oligonucleotide
  Target: AGXT; (-) strand; PAM type: NRG; PAM sequence: AGG
agagtgagctcccgggagtc

SEQ ID NO: 7752 - DNA, 20 bp, Artificial Sequence
  Description of Artificial Sequence: Synthetic oligonucleotide
  Target: AGXT; (-) strand; PAM type: NRG; PAM sequence: CAG
gagagtgagctcccgggagt

SEQ ID NO: 7753 - DNA, 20 bp, Artificial Sequence
  Description of Artificial Sequence: Synthetic oligonucleotide
  Target: AGXT; (-) strand; PAM type: NRG; PAM sequence: GAG
agcagagagtgagctcccgg

SEQ ID NO: 7754 - DNA, 20 bp, Artificial Sequence
  Description of Artificial Sequence: Synthetic oligonucleotide
  Target: AGXT; (-) strand; PAM type: NRG; PAM sequence: GGG
caagcagagagtgagctccc

SEQ ID NO: 7755 - DNA, 20 bp, Artificial Sequence
  Description of Artificial Sequence: Synthetic oligonucleotide
  Target: AGXT; (-) strand; PAM type: NRG; PAM sequence: CGG
ccaagcagagagtgagctcc

SEQ ID NO: 7756 - DNA, 20 bp, Artificial Sequence
  Description of Artificial Sequence: Synthetic oligonucleotide
  Target: AGXT; (-) strand; PAM type: NRG; PAM sequence: GAG
tgcctccccaagcagagagt

SEQ ID NO: 7757 - DNA, 20 bp, Artificial Sequence
  Description of Artificial Sequence: Synthetic oligonucleotide
  Target: AGXT; (-) strand; PAM type: NRG; PAM sequence: GAG
ccagtgcctccccaagcaga

SEQ ID NO: 7758 - DNA, 20 bp, Artificial Sequence
  Description of Artificial Sequence: Synthetic oligonucleotide
  Target: AGXT; (-) strand; PAM type: NRG; PAM sequence: GAG
gaccagtgcctccccaagca

SEQ ID NO: 7759 - DNA, 20 bp, Artificial Sequence
  Description of Artificial Sequence: Synthetic oligonucleotide
  Target: AGXT; (-) strand; PAM type: NRG; PAM sequence: CAG
ctgaccagtgcctccccaag

SEQ ID NO: 7760 - DNA, 20 bp, Artificial Sequence
  Description of Artificial Sequence: Synthetic oligonucleotide
  Target: AGXT; (-) strand; PAM type: NRG; PAM sequence: AAG
acactgaccagtgcctcccc

SEQ ID NO: 7761 - DNA, 20 bp, Artificial Sequence
  Description of Artificial Sequence: Synthetic oligonucleotide
  Target: AGXT; (-) strand; PAM type: NRG; PAM sequence: CAG
ctttctcaggccacactgac

SEQ ID NO: 7762 - DNA, 20 bp, Artificial Sequence
  Description of Artificial Sequence: Synthetic oligonucleotide
  Target: AGXT; (-) strand; PAM type: NRG; PAM sequence: AGG
cagctcaaatgccctttctc

SEQ ID NO: 7763 - DNA, 20 bp, Artificial Sequence
  Description of Artificial Sequence: Synthetic oligonucleotide
  Target: AGXT; (-) strand; PAM type: NRG; PAM sequence: CAG
tcagctcaaatgccctttct

SEQ ID NO: 7764 - DNA, 20 bp, Artificial Sequence
  Description of Artificial Sequence: Synthetic oligonucleotide
  Target: AGXT; (-) strand; PAM type: NRG; PAM sequence: CAG
ggggcactcttgacagagct

SEQ ID NO: 7765 - DNA, 20 bp, Artificial Sequence
  Description of Artificial Sequence: Synthetic oligonucleotide
  Target: AGXT; (-) strand; PAM type: NRG; PAM sequence: GAG
ctcctggggcactcttgaca

SEQ ID NO: 7766 - DNA, 20 bp, Artificial Sequence
  Description of Artificial Sequence: Synthetic oligonucleotide
  Target: AGXT; (-) strand; PAM type: NRG; PAM sequence: CAG
cgctcctggggcactcttga

SEQ ID NO: 7767 - DNA, 20 bp, Artificial Sequence
  Description of Artificial Sequence: Synthetic oligonucleotide
  Target: AGXT; (-) strand; PAM type: NRG; PAM sequence: GGG
tgttggagccaacgctcctg

SEQ ID NO: 7768 - DNA, 20 bp, Artificial Sequence
  Description of Artificial Sequence: Synthetic oligonucleotide
  Target: AGXT; (-) strand; PAM type: NRG; PAM sequence: GGG
ctgttggagccaacgctcct

SEQ ID NO: 7769 - DNA, 20 bp, Artificial Sequence
  Description of Artificial Sequence: Synthetic oligonucleotide
  Target: AGXT; (-) strand; PAM type: NRG; PAM sequence: TGG
gctgttggagccaacgctcc

SEQ ID NO: 7770 - DNA, 20 bp, Artificial Sequence
  Description of Artificial Sequence: Synthetic oligonucleotide
  Target: AGXT; (-) strand; PAM type: NRG; PAM sequence: GAG
tcttgacccccctgctgttg

SEQ ID NO: 7771 - DNA, 20 bp, Artificial Sequence
  Description of Artificial Sequence: Synthetic oligonucleotide
  Target: AGXT; (-) strand; PAM type: NRG; PAM sequence: TGG
catcttgacccccctgctgt

SEQ ID NO: 7772 - DNA, 20 bp, Artificial Sequence
  Description of Artificial Sequence: Synthetic oligonucleotide
  Target: AGXT; (-) strand; PAM type: NRG; PAM sequence: GGG
cctctctgtgtgtagagcca

SEQ ID NO: 7773 - DNA, 20 bp, Artificial Sequence
  Description of Artificial Sequence: Synthetic oligonucleotide
  Target: AGXT; (-) strand; PAM type: NRG; PAM sequence: AGG
gcctctctgtgtgtagagcc

SEQ ID NO: 7774 - DNA, 20 bp, Artificial Sequence
  Description of Artificial Sequence: Synthetic oligonucleotide
  Target: AGXT; (-) strand; PAM type: NRG; PAM sequence: CAG
agcctctctgtgtgtagagc

SEQ ID NO: 7775 - DNA, 20 bp, Artificial Sequence
  Description of Artificial Sequence: Synthetic oligonucleotide
  Target: AGXT; (-) strand; PAM type: NRG; PAM sequence: GAG
tgagagcctctctgtgtgta

SEQ ID NO: 7776 - DNA, 20 bp, Artificial Sequence
  Description of Artificial Sequence: Synthetic oligonucleotide
  Target: AGXT; (-) strand; PAM type: NRG; PAM sequence: TAG
aatgagagcctctctgtgtg

SEQ ID NO: 7777 - DNA, 20 bp, Artificial Sequence
  Description of Artificial Sequence: Synthetic oligonucleotide
  Target: AGXT; (-) strand; PAM type: NRG; PAM sequence: GAG
gggtggactctgcccaatga

SEQ ID NO: 7778 - DNA, 20 bp, Artificial Sequence
  Description of Artificial Sequence: Synthetic oligonucleotide
  Target: AGXT; (-) strand; PAM type: NRG; PAM sequence: GAG
gagggtggactctgcccaat

SEQ ID NO: 7779 - DNA, 20 bp, Artificial Sequence
  Description of Artificial Sequence: Synthetic oligonucleotide
  Target: AGXT; (-) strand; PAM type: NRG; PAM sequence: TGG
tgcctgcctgaagaggaggg

SEQ ID NO: 7780 - DNA, 20 bp, Artificial Sequence
  Description of Artificial Sequence: Synthetic oligonucleotide
  Target: AGXT; (-) strand; PAM type: NRG; PAM sequence: GGG
ggctgcctgcctgaagagga

SEQ ID NO: 7781 - DNA, 20 bp, Artificial Sequence
  Description of Artificial Sequence: Synthetic oligonucleotide
  Target: AGXT; (-) strand; PAM type: NRG; PAM sequence: AGG
tggctgcctgcctgaagagg

SEQ ID NO: 7782 - DNA, 20 bp, Artificial Sequence
  Description of Artificial Sequence: Synthetic oligonucleotide
  Target: AGXT; (-) strand; PAM type: NRG; PAM sequence: GAG
ctggctgcctgcctgaagag

SEQ ID NO: 7783 - DNA, 20 bp, Artificial Sequence
  Description of Artificial Sequence: Synthetic oligonucleotide
  Target: AGXT; (-) strand; PAM type: NRG; PAM sequence: AGG
ccctggctgcctgcctgaag

SEQ ID NO: 7784 - DNA, 20 bp, Artificial Sequence
  Description of Artificial Sequence: Synthetic oligonucleotide
  Target: AGXT; (-) strand; PAM type: NRG; PAM sequence: GAG
accctggctgcctgcctgaa

SEQ ID NO: 7785 - DNA, 20 bp, Artificial Sequence
  Description of Artificial Sequence: Synthetic oligonucleotide
  Target: AGXT; (-) strand; PAM type: NRG; PAM sequence: AAG
gcaccctggctgcctgcctg

SEQ ID NO: 7786 - DNA, 20 bp, Artificial Sequence
  Description of Artificial Sequence: Synthetic oligonucleotide
  Target: AGXT; (-) strand; PAM type: NRG; PAM sequence: TGG
ccccacccaccgtggcaccc

SEQ ID NO: 7787 - DNA, 20 bp, Artificial Sequence
  Description of Artificial Sequence: Synthetic oligonucleotide
  Target: AGXT; (-) strand; PAM type: NRG; PAM sequence: TGG
gggctggaccccacccaccg

SEQ ID NO: 7788 - DNA, 20 bp, Artificial Sequence
  Description of Artificial Sequence: Synthetic oligonucleotide
  Target: AGXT; (-) strand; PAM type: NRG; PAM sequence: TGG
gagcagggccctgtgagggc

SEQ ID NO: 7789 - DNA, 20 bp, Artificial Sequence
  Description of Artificial Sequence: Synthetic oligonucleotide
  Target: AGXT; (-) strand; PAM type: NRG; PAM sequence: GGG
tgctgagcagggccctgtga

SEQ ID NO: 7790 - DNA, 20 bp, Artificial Sequence
  Description of Artificial Sequence: Synthetic oligonucleotide
  Target: AGXT; (-) strand; PAM type: NRG; PAM sequence: AGG
ctgctgagcagggccctgtg

SEQ ID NO: 7791 - DNA, 20 bp, Artificial Sequence
  Description of Artificial Sequence: Synthetic oligonucleotide
  Target: AGXT; (-) strand; PAM type: NRG; PAM sequence: GAG
cctgctgagcagggccctgt

SEQ ID NO: 7792 - DNA, 20 bp, Artificial Sequence
  Description of Artificial Sequence: Synthetic oligonucleotide
  Target: AGXT; (-) strand; PAM type: NRG; PAM sequence: GGG
acccgtggccctgctgagca

SEQ ID NO: 7793 - DNA, 20 bp, Artificial Sequence
  Description of Artificial Sequence: Synthetic oligonucleotide
  Target: AGXT; (-) strand; PAM type: NRG; PAM sequence: AGG
cacccgtggccctgctgagc

SEQ ID NO: 7794 - DNA, 20 bp, Artificial Sequence
  Description of Artificial Sequence: Synthetic oligonucleotide
  Target: AGXT; (-) strand; PAM type: NRG; PAM sequence: CAG
gcacccgtggccctgctgag

SEQ ID NO: 7795 - DNA, 20 bp, Artificial Sequence
  Description of Artificial Sequence: Synthetic oligonucleotide
  Target: AGXT; (-) strand; PAM type: NRG; PAM sequence: GAG
tgggcacccgtggccctgct

SEQ ID NO: 7796 - DNA, 20 bp, Artificial Sequence
  Description of Artificial Sequence: Synthetic oligonucleotide
  Target: AGXT; (-) strand; PAM type: NRG; PAM sequence: TGG
aagccagtgttgggcacccg

SEQ ID NO: 7797 - DNA, 20 bp, Artificial Sequence
  Description of Artificial Sequence: Synthetic oligonucleotide
  Target: AGXT; (-) strand; PAM type: NRG; PAM sequence: GGG
acactgtagaagccagtgtt

SEQ ID NO: 7798 - DNA, 20 bp, Artificial Sequence
  Description of Artificial Sequence: Synthetic oligonucleotide
  Target: AGXT; (-) strand; PAM type: NRG; PAM sequence: TGG
cacactgtagaagccagtgt

SEQ ID NO: 7799 - DNA, 20 bp, Artificial Sequence
  Description of Artificial Sequence: Synthetic oligonucleotide
  Target: AGXT; (-) strand; PAM type: NRG; PAM sequence: CAG
cccgcacacactgtagaagc

SEQ ID NO: 7800 - DNA, 20 bp, Artificial Sequence
  Description of Artificial Sequence: Synthetic oligonucleotide
  Target: AGXT; (-) strand; PAM type: NRG; PAM sequence: AAG
gtgtcccgcacacactgtag

SEQ ID NO: 7801 - DNA, 20 bp, Artificial Sequence
  Description of Artificial Sequence: Synthetic oligonucleotide
  Target: AGXT; (-) strand; PAM type: NRG; PAM sequence: TAG
tgagtgtcccgcacacactg

SEQ ID NO: 7802 - DNA, 20 bp, Artificial Sequence
  Description of Artificial Sequence: Synthetic oligonucleotide
  Target: AGXT; (-) strand; PAM type: NRG; PAM sequence: GAG
tgcaggacagagtgggccgt

SEQ ID NO: 7803 - DNA, 20 bp, Artificial Sequence
  Description of Artificial Sequence: Synthetic oligonucleotide
  Target: AGXT; (-) strand; PAM type: NRG; PAM sequence: GGG
tcctgggtgcaggacagagt

SEQ ID NO: 7804 - DNA, 20 bp, Artificial Sequence
  Description of Artificial Sequence: Synthetic oligonucleotide
  Target: AGXT; (-) strand; PAM type: NRG; PAM sequence: TGG
ctcctgggtgcaggacagag

SEQ ID NO: 7805 - DNA, 20 bp, Artificial Sequence
  Description of Artificial Sequence: Synthetic oligonucleotide
  Target: AGXT; (-) strand; PAM type: NRG; PAM sequence: GAG
gggctcctgggtgcaggaca

SEQ ID NO: 7806 - DNA, 20 bp, Artificial Sequence
  Description of Artificial Sequence: Synthetic oligonucleotide
  Target: AGXT; (-) strand; PAM type: NRG; PAM sequence: CAG
tcgggctcctgggtgcagga

SEQ ID NO: 7807 - DNA, 20 bp, Artificial Sequence
  Description of Artificial Sequence: Synthetic oligonucleotide
  Target: AGXT; (-) strand; PAM type: NRG; PAM sequence: AGG
gcactcgggctcctgggtgc

SEQ ID NO: 7808 - DNA, 20 bp, Artificial Sequence
  Description of Artificial Sequence: Synthetic oligonucleotide
  Target: AGXT; (-) strand; PAM type: NRG; PAM sequence: CAG
tgcactcgggctcctgggtg

SEQ ID NO: 7809 - DNA, 20 bp, Artificial Sequence
  Description of Artificial Sequence: Synthetic oligonucleotide
  Target: AGXT; (-) strand; PAM type: NRG; PAM sequence: GGG
tcgggtgcactcgggctcct

SEQ ID NO: 7810 - DNA, 20 bp, Artificial Sequence
  Description of Artificial Sequence: Synthetic oligonucleotide
  Target: AGXT; (-) strand; PAM type: NRG; PAM sequence: TGG
atcgggtgcactcgggctcc

SEQ ID NO: 7811 - DNA, 20 bp, Artificial Sequence
  Description of Artificial Sequence: Synthetic oligonucleotide
  Target: AGXT; (-) strand; PAM type: NRG; PAM sequence: GGG
cttggtcatcgggtgcactc

SEQ ID NO: 7812 - DNA, 20 bp, Artificial Sequence
  Description of Artificial Sequence: Synthetic oligonucleotide
  Target: AGXT; (-) strand; PAM type: NRG; PAM sequence: CGG
ccttggtcatcgggtgcact

SEQ ID NO: 7813 - DNA, 20 bp, Artificial Sequence
  Description of Artificial Sequence: Synthetic oligonucleotide
  Target: AGXT; (-) strand; PAM type: NRG; PAM sequence: GGG
ctccagggtccttggtcatc

SEQ ID NO: 7814 - DNA, 20 bp, Artificial Sequence
  Description of Artificial Sequence: Synthetic oligonucleotide
  Target: AGXT; (-) strand; PAM type: NRG; PAM sequence: CGG
cctccagggtccttggtcat

SEQ ID NO: 7815 - DNA, 20 bp, Artificial Sequence
  Description of Artificial Sequence: Synthetic oligonucleotide
  Target: AGXT; (-) strand; PAM type: NRG; PAM sequence: TGG
gtagtggcctccagggtcct

SEQ ID NO: 7816 - DNA, 20 bp, Artificial Sequence
  Description of Artificial Sequence: Synthetic oligonucleotide
  Target: AGXT; (-) strand; PAM type: NRG; PAM sequence: GGG
gcagtgtgtagtggcctcca

SEQ ID NO: 7817 - DNA, 20 bp, Artificial Sequence
  Description of Artificial Sequence: Synthetic oligonucleotide
  Target: AGXT; (-) strand; PAM type: NRG; PAM sequence: AGG
tgcagtgtgtagtggcctcc

SEQ ID NO: 7818 - DNA, 20 bp, Artificial Sequence
  Description of Artificial Sequence: Synthetic oligonucleotide
  Target: AGXT; (-) strand; PAM type: NRG; PAM sequence: CAG
ctgcagtgtgtagtggcctc

SEQ ID NO: 7819 - DNA, 20 bp, Artificial Sequence
  Description of Artificial Sequence: Synthetic oligonucleotide
  Target: AGXT; (-) strand; PAM type: NRG; PAM sequence: TGG
ccacctcctgcagtgtgtag

SEQ ID NO: 7820 - DNA, 20 bp, Artificial Sequence
  Description of Artificial Sequence: Synthetic oligonucleotide
  Target: AGXT; (-) strand; PAM type: NRG; PAM sequence: TAG
cctccacctcctgcagtgtg

SEQ ID NO: 7821 - DNA, 20 bp, Artificial Sequence
  Description of Artificial Sequence: Synthetic oligonucleotide
  Target: AGXT; (-) strand; PAM type: NRG; PAM sequence: CAG
cctacctcctccacctcctg

SEQ ID NO: 7822 - DNA, 20 bp, Artificial Sequence
  Description of Artificial Sequence: Synthetic oligonucleotide
  Target: AGXT; (-) strand; PAM type: NRG; PAM sequence: GGG
ccggccctgacccccacccc

SEQ ID NO: 7823 - DNA, 20 bp, Artificial Sequence
  Description of Artificial Sequence: Synthetic oligonucleotide
  Target: AGXT; (-) strand; PAM type: NRG; PAM sequence: CGG
cccggccctgacccccaccc

SEQ ID NO: 7824 - DNA, 20 bp, Artificial Sequence
  Description of Artificial Sequence: Synthetic oligonucleotide
  Target: AGXT; (-) strand; PAM type: NRG; PAM sequence: CGG
tgcccactcccacctcctcc

SEQ ID NO: 7825 - DNA, 20 bp, Artificial Sequence
  Description of Artificial Sequence: Synthetic oligonucleotide
  Target: AGXT; (-) strand; PAM type: NRG; PAM sequence: CAG
attccaggcagcccctgagc

SEQ ID NO: 7826 - DNA, 20 bp, Artificial Sequence
  Description of Artificial Sequence: Synthetic oligonucleotide
  Target: AGXT; (-) strand; PAM type: NRG; PAM sequence: GAG
gccaattccaggcagcccct

SEQ ID NO: 7827 - DNA, 20 bp, Artificial Sequence
  Description of Artificial Sequence: Synthetic oligonucleotide
  Target: AGXT; (-) strand; PAM type: NRG; PAM sequence: CAG
gctggctggccaattccagg

SEQ ID NO: 7828 - DNA, 20 bp, Artificial Sequence
  Description of Artificial Sequence: Synthetic oligonucleotide
  Target: AGXT; (-) strand; PAM type: NRG; PAM sequence: AGG
cctgctggctggccaattcc

SEQ ID NO: 7829 - DNA, 20 bp, Artificial Sequence
  Description of Artificial Sequence: Synthetic oligonucleotide
  Target: AGXT; (-) strand; PAM type: NRG; PAM sequence: CAG
ccctgctggctggccaattc

SEQ ID NO: 7830 - DNA, 20 bp, Artificial Sequence
  Description of Artificial Sequence: Synthetic oligonucleotide
  Target: AGXT; (-) strand; PAM type: NRG; PAM sequence: TGG
catgatcccaccctgctggc

SEQ ID NO: 7831 - DNA, 20 bp, Artificial Sequence
  Description of Artificial Sequence: Synthetic oligonucleotide
  Target: AGXT; (-) strand; PAM type: NRG; PAM sequence: TGG
cggccatgatcccaccctgc

SEQ ID NO: 7832 - DNA, 20 bp, Artificial Sequence
  Description of Artificial Sequence: Synthetic oligonucleotide
  Target: AGXT; (-) strand; PAM type: NRG; PAM sequence: CGG
agggtcagccaccagcctcc

SEQ ID NO: 7833 - DNA, 20 bp, Artificial Sequence
  Description of Artificial Sequence: Synthetic oligonucleotide
  Target: AGXT; (-) strand; PAM type: NRG; PAM sequence: CAG
atgggctgagggtcagccac

SEQ ID NO: 7834 - DNA, 20 bp, Artificial Sequence
  Description of Artificial Sequence: Synthetic oligonucleotide
  Target: AGXT; (-) strand; PAM type: NRG; PAM sequence: CAG
tgctaggatgggctgagggt

SEQ ID NO: 7835 - DNA, 20 bp, Artificial Sequence
  Description of Artificial Sequence: Synthetic oligonucleotide
  Target: AGXT; (-) strand; PAM type: NRG; PAM sequence: GGG
cagatgctaggatgggctga

SEQ ID NO: 7836 - DNA, 20 bp, Artificial Sequence
  Description of Artificial Sequence: Synthetic oligonucleotide
  Target: AGXT; (-) strand; PAM type: NRG; PAM sequence: AGG
ccagatgctaggatgggctg

SEQ ID NO: 7837 - DNA, 20 bp, Artificial Sequence
  Description of Artificial Sequence: Synthetic oligonucleotide
  Target: AGXT; (-) strand; PAM type: NRG; PAM sequence: GAG
accagatgctaggatgggct

SEQ ID NO: 7838 - DNA, 20 bp, Artificial Sequence
  Description of Artificial Sequence: Synthetic oligonucleotide
  Target: AGXT; (-) strand; PAM type: NRG; PAM sequence: GGG
cgctcaccagatgctaggat

SEQ ID NO: 7839 - DNA, 20 bp, Artificial Sequence
  Description of Artificial Sequence: Synthetic oligonucleotide
  Target: AGXT; (-) strand; PAM type: NRG; PAM sequence: TGG
ccgctcaccagatgctagga

SEQ ID NO: 7840 - DNA, 20 bp, Artificial Sequence
  Description of Artificial Sequence: Synthetic oligonucleotide
  Target: AGXT; (-) strand; PAM type: NRG; PAM sequence: AGG
gtggccgctcaccagatgct

SEQ ID NO: 7841 - DNA, 20 bp, Artificial Sequence
  Description of Artificial Sequence: Synthetic oligonucleotide
  Target: AGXT; (-) strand; PAM type: NRG; PAM sequence: TAG
tgtggccgctcaccagatgc

SEQ ID NO: 7842 - DNA, 20 bp, Artificial Sequence
  Description of Artificial Sequence: Synthetic oligonucleotide
  Target: AGXT; (-) strand; PAM type: NRG; PAM sequence: CAG
cctcccctgtggccgctcac

SEQ ID NO: 7843 - DNA, 20 bp, Artificial Sequence
  Description of Artificial Sequence: Synthetic oligonucleotide
  Target: AGXT; (-) strand; PAM type: NRG; PAM sequence: TGG
ggtaatggaaccctcccctg

SEQ ID NO: 7844 - DNA, 20 bp, Artificial Sequence
  Description of Artificial Sequence: Synthetic oligonucleotide
  Target: AGXT; (-) strand; PAM type: NRG; PAM sequence: TGG
ttcccaccattcccaggtaa

SEQ ID NO: 7845 - DNA, 20 bp, Artificial Sequence
  Description of Artificial Sequence: Synthetic oligonucleotide
  Target: AGXT; (-) strand; PAM type: NRG; PAM sequence: AGG
ccagtcttcccaccattccc

SEQ ID NO: 7846 - DNA, 20 bp, Artificial Sequence
  Description of Artificial Sequence: Synthetic oligonucleotide
  Target: AGXT; (-) strand; PAM type: NRG; PAM sequence: CAG
accagtcttcccaccattcc

SEQ ID NO: 7847 - DNA, 20 bp, Artificial Sequence
  Description of Artificial Sequence: Synthetic oligonucleotide
  Target: AGXT; (-) strand; PAM type: NRG; PAM sequence: CAG
ccagacagaagcctccttac

SEQ ID NO: 7848 - DNA, 20 bp, Artificial Sequence
  Description of Artificial Sequence: Synthetic oligonucleotide
  Target: AGXT; (-) strand; PAM type: NRG; PAM sequence: AAG
tcagtttccctgccagacag

SEQ ID NO: 7849 - DNA, 20 bp, Artificial Sequence
  Description of Artificial Sequence: Synthetic oligonucleotide
  Target: AGXT; (-) strand; PAM type: NRG; PAM sequence: CAG
gactcagtttccctgccaga

SEQ ID NO: 7850 - DNA, 20 bp, Artificial Sequence
  Description of Artificial Sequence: Synthetic oligonucleotide
  Target: AGXT; (-) strand; PAM type: NRG; PAM sequence: CAG
tcctgactcagtttccctgc

SEQ ID NO: 7851 - DNA, 20 bp, Artificial Sequence
  Description of Artificial Sequence: Synthetic oligonucleotide
  Target: AGXT; (-) strand; PAM type: NRG; PAM sequence: CAG
acaggaccaggctcctgact

SEQ ID NO: 7852 - DNA, 20 bp, Artificial Sequence
  Description of Artificial Sequence: Synthetic oligonucleotide
  Target: AGXT; (-) strand; PAM type: NRG; PAM sequence: AGG
ctggccctgcctacaggacc

SEQ ID NO: 7853 - DNA, 20 bp, Artificial Sequence
  Description of Artificial Sequence: Synthetic oligonucleotide
  Target: AGXT; (-) strand; PAM type: NRG; PAM sequence: CAG
tctggccctgcctacaggac

SEQ ID NO: 7854 - DNA, 20 bp, Artificial Sequence
  Description of Artificial Sequence: Synthetic oligonucleotide
  Target: AGXT; (-) strand; PAM type: NRG; PAM sequence: AGG
gcctctctggccctgcctac

SEQ ID NO: 7855 - DNA, 20 bp, Artificial Sequence
  Description of Artificial Sequence: Synthetic oligonucleotide
  Target: AGXT; (-) strand; PAM type: NRG; PAM sequence: CAG
agcctctctggccctgccta

SEQ ID NO: 7856 - DNA, 20 bp, Artificial Sequence
  Description of Artificial Sequence: Synthetic oligonucleotide
  Target: AGXT; (-) strand; PAM type: NRG; PAM sequence: TGG
cctcctgcctccagcctctc

SEQ ID NO: 7857 - DNA, 20 bp, Artificial Sequence
  Description of Artificial Sequence: Synthetic oligonucleotide
  Target: AGXT; (-) strand; PAM type: NRG; PAM sequence: CAG
ccaactcggcctcctgcctc

SEQ ID NO: 7858 - DNA, 20 bp, Artificial Sequence
  Description of Artificial Sequence: Synthetic oligonucleotide
  Target: AGXT; (-) strand; PAM type: NRG; PAM sequence: CGG
ctgcagcctagactccaact

SEQ ID NO: 7859 - DNA, 20 bp, Artificial Sequence
  Description of Artificial Sequence: Synthetic oligonucleotide
  Target: AGXT; (-) strand; PAM type: NRG; PAM sequence: TAG
cagggacatgttctgcagcc

SEQ ID NO: 7860 - DNA, 20 bp, Artificial Sequence
  Description of Artificial Sequence: Synthetic oligonucleotide
  Target: AGXT; (-) strand; PAM type: NRG; PAM sequence: CAG
agtgtcagggacatgttctg

SEQ ID NO: 7861 - DNA, 20 bp, Artificial Sequence
  Description of Artificial Sequence: Synthetic oligonucleotide
  Target: AGXT; (-) strand; PAM type: NRG; PAM sequence: GGG
gtggggtatcctgagtgtca

SEQ ID NO: 7862 - DNA, 20 bp, Artificial Sequence
  Description of Artificial Sequence: Synthetic oligonucleotide
  Target: AGXT; (-) strand; PAM type: NRG; PAM sequence: AGG
ggtggggtatcctgagtgtc

SEQ ID NO: 7863 - DNA, 20 bp, Artificial Sequence
  Description of Artificial Sequence: Synthetic oligonucleotide
  Target: AGXT; (-) strand; PAM type: NRG; PAM sequence: CAG
gggtggggtatcctgagtgt

SEQ ID NO: 7864 - DNA, 20 bp, Artificial Sequence
  Description of Artificial Sequence: Synthetic oligonucleotide
  Target: AGXT; (-) strand; PAM type: NRG; PAM sequence: GAG
cccacagggtggggtatcct

SEQ ID NO: 7865 - DNA, 20 bp, Artificial Sequence
  Description of Artificial Sequence: Synthetic oligonucleotide
  Target: AGXT; (-) strand; PAM type: NRG; PAM sequence: GGG
tgacttcagcccacagggtg

SEQ ID NO: 7866 - DNA, 20 bp, Artificial Sequence
  Description of Artificial Sequence: Synthetic oligonucleotide
  Target: AGXT; (-) strand; PAM type: NRG; PAM sequence: GGG
ttgacttcagcccacagggt

SEQ ID NO: 7867 - DNA, 20 bp, Artificial Sequence
  Description of Artificial Sequence: Synthetic oligonucleotide
  Target: AGXT; (-) strand; PAM type: NRG; PAM sequence: TGG
gttgacttcagcccacaggg

SEQ ID NO: 7868 - DNA, 20 bp, Artificial Sequence
  Description of Artificial Sequence: Synthetic oligonucleotide
  Target: AGXT; (-) strand; PAM type: NRG; PAM sequence: GGG
gaggttgacttcagcccaca

SEQ ID NO: 7869 - DNA, 20 bp, Artificial Sequence
  Description of Artificial Sequence: Synthetic oligonucleotide
  Target: AGXT; (-) strand; PAM type: NRG; PAM sequence: AGG
tgaggttgacttcagcccac

SEQ ID NO: 7870 - DNA, 20 bp, Artificial Sequence
  Description of Artificial Sequence: Synthetic oligonucleotide
  Target: AGXT; (-) strand; PAM type: NRG; PAM sequence: CAG
ctgaggttgacttcagccca

SEQ ID NO: 7871 - DNA, 20 bp, Artificial Sequence
  Description of Artificial Sequence: Synthetic oligonucleotide
  Target: AGXT; (-) strand; PAM type: NRG; PAM sequence: CAG
gggtaggctgaggttgactt

SEQ ID NO: 7872 - DNA, 20 bp, Artificial Sequence
  Description of Artificial Sequence: Synthetic oligonucleotide
  Target: AGXT; (-) strand; PAM type: NRG; PAM sequence: AGG
cccacactccgggtaggctg

SEQ ID NO: 7873 - DNA, 20 bp, Artificial Sequence
  Description of Artificial Sequence: Synthetic oligonucleotide
  Target: AGXT; (-) strand; PAM type: NRG; PAM sequence: GAG
ccccacactccgggtaggct

SEQ ID NO: 7874 - DNA, 20 bp, Artificial Sequence
  Description of Artificial Sequence: Synthetic oligonucleotide
  Target: AGXT; (-) strand; PAM type: NRG; PAM sequence: AGG
tgagtccccacactccgggt

SEQ ID NO: 7875 - DNA, 20 bp, Artificial Sequence
  Description of Artificial Sequence: Synthetic oligonucleotide
  Target: AGXT; (-) strand; PAM type: NRG; PAM sequence: TAG
ctgagtccccacactccggg

SEQ ID NO: 7876 - DNA, 20 bp, Artificial Sequence
  Description of Artificial Sequence: Synthetic oligonucleotide
  Target: AGXT; (-) strand; PAM type: NRG; PAM sequence: GGG
ggactgagtccccacactcc

SEQ ID NO: 7877 - DNA, 20 bp, Artificial Sequence
  Description of Artificial Sequence: Synthetic oligonucleotide
  Target: AGXT; (-) strand; PAM type: NRG; PAM sequence: CGG
tggactgagtccccacactc

SEQ ID NO: 7878 - DNA, 20 bp, Artificial Sequence
  Description of Artificial Sequence: Synthetic oligonucleotide
  Target: AGXT; (-) strand; PAM type: NRG; PAM sequence: GAG
gggctgttgctagatggact

SEQ ID NO: 7879 - DNA, 20 bp, Artificial Sequence
  Description of Artificial Sequence: Synthetic oligonucleotide
  Target: AGXT; (-) strand; PAM type: NRG; PAM sequence: TGG
ctgtgagggctgttgctaga

SEQ ID NO: 7880 - DNA, 20 bp, Artificial Sequence
  Description of Artificial Sequence: Synthetic oligonucleotide
  Target: AGXT; (-) strand; PAM type: NRG; PAM sequence: TAG
tggcctgtgagggctgttgc

SEQ ID NO: 7881 - DNA, 20 bp, Artificial Sequence
  Description of Artificial Sequence: Synthetic oligonucleotide
  Target: AGXT; (-) strand; PAM type: NRG; PAM sequence: GGG
gcctgttgcctggcctgtga

SEQ ID NO: 7882 - DNA, 20 bp, Artificial Sequence
  Description of Artificial Sequence: Synthetic oligonucleotide
  Target: AGXT; (-) strand; PAM type: NRG; PAM sequence: AGG
agcctgttgcctggcctgtg

SEQ ID NO: 7883 - DNA, 20 bp, Artificial Sequence
  Description of Artificial Sequence: Synthetic oligonucleotide
  Target: AGXT; (-) strand; PAM type: NRG; PAM sequence: GAG
cagcctgttgcctggcctgt

SEQ ID NO: 7884 - DNA, 20 bp, Artificial Sequence
  Description of Artificial Sequence: Synthetic oligonucleotide
  Target: AGXT; (-) strand; PAM type: NRG; PAM sequence: TGG
ggtgcccccagcctgttgcc

SEQ ID NO: 7885 - DNA, 20 bp, Artificial Sequence
  Description of Artificial Sequence: Synthetic oligonucleotide
  Target: AGXT; (-) strand; PAM type: NRG; PAM sequence: CAG
gagatggaggagggtgcccc

SEQ ID NO: 7886 - DNA, 20 bp, Artificial Sequence
  Description of Artificial Sequence: Synthetic oligonucleotide
  Target: AGXT; (-) strand; PAM type: NRG; PAM sequence: GGG
tttggtgcagagatggagga

SEQ ID NO: 7887 - DNA, 20 bp, Artificial Sequence
  Description of Artificial Sequence: Synthetic oligonucleotide
  Target: AGXT; (-) strand; PAM type: NRG; PAM sequence: AGG
ctttggtgcagagatggagg

SEQ ID NO: 7888 - DNA, 20 bp, Artificial Sequence
  Description of Artificial Sequence: Synthetic oligonucleotide
  Target: AGXT; (-) strand; PAM type: NRG; PAM sequence: GAG
actttggtgcagagatggag

SEQ ID NO: 7889 - DNA, 20 bp, Artificial Sequence
  Description of Artificial Sequence: Synthetic oligonucleotide
  Target: AGXT; (-) strand; PAM type: NRG; PAM sequence: AGG
ggactttggtgcagagatgg

SEQ ID NO: 7890 - DNA, 20 bp, Artificial Sequence
  Description of Artificial Sequence: Synthetic oligonucleotide
  Target: AGXT; (-) strand; PAM type: NRG; PAM sequence: GAG
aggactttggtgcagagatg

SEQ ID NO: 7891 - DNA, 20 bp, Artificial Sequence
  Description of Artificial Sequence: Synthetic oligonucleotide
  Target: AGXT; (-) strand; PAM type: NRG; PAM sequence: TGG
acaggactttggtgcagaga

SEQ ID NO: 7892 - DNA, 20 bp, Artificial Sequence
  Description of Artificial Sequence: Synthetic oligonucleotide
  Target: AGXT; (-) strand; PAM type: NRG; PAM sequence: GAG
aagaacaggactttggtgca

SEQ ID NO: 7893 - DNA, 20 bp, Artificial Sequence
  Description of Artificial Sequence: Synthetic oligonucleotide
  Target: AGXT; (-) strand; PAM type: NRG; PAM sequence: CAG
ccaagaacaggactttggtg

SEQ ID NO: 7894 - DNA, 20 bp, Artificial Sequence
  Description of Artificial Sequence: Synthetic oligonucleotide
  Target: AGXT; (-) strand; PAM type: NRG; PAM sequence: TGG
cttttccaagaacaggactt

SEQ ID NO: 7895 - DNA, 20 bp, Artificial Sequence
  Description of Artificial Sequence: Synthetic oligonucleotide
  Target: AGXT; (-) strand; PAM type: NRG; PAM sequence: AGG
acaagggcttttccaagaac

SEQ ID NO: 7896 - DNA, 20 bp, Artificial Sequence
  Description of Artificial Sequence: Synthetic oligonucleotide
  Target: AGXT; (-) strand; PAM type: NRG; PAM sequence: CAG
gacaagggcttttccaagaa

SEQ ID NO: 7897 - DNA, 20 bp, Artificial Sequence
  Description of Artificial Sequence: Synthetic oligonucleotide
  Target: AGXT; (-) strand; PAM type: NRG; PAM sequence: AAG
tccgggacaagggcttttcc

SEQ ID NO: 7898 - DNA, 20 bp, Artificial Sequence
  Description of Artificial Sequence: Synthetic oligonucleotide
  Target: AGXT; (-) strand; PAM type: NRG; PAM sequence: GGG
gcatctccgctccgggacaa

SEQ ID NO: 7899 - DNA, 20 bp, Artificial Sequence
  Description of Artificial Sequence: Synthetic oligonucleotide
  Target: AGXT; (-) strand; PAM type: NRG; PAM sequence: AGG
ggcatctccgctccgggaca

SEQ ID NO: 7900 - DNA, 20 bp, Artificial Sequence
  Description of Artificial Sequence: Synthetic oligonucleotide
  Target: AGXT; (-) strand; PAM type: NRG; PAM sequence: AAG
gggcatctccgctccgggac

SEQ ID NO: 7901 - DNA, 20 bp, Artificial Sequence
  Description of Artificial Sequence: Synthetic oligonucleotide
  Target: AGXT; (-) strand; PAM type: NRG; PAM sequence: GGG
ggctggggcatctccgctcc

SEQ ID NO: 7902 - DNA, 20 bp, Artificial Sequence
  Description of Artificial Sequence: Synthetic oligonucleotide
  Target: AGXT; (-) strand; PAM type: NRG; PAM sequence: CGG
aggctggggcatctccgctc

SEQ ID NO: 7903 - DNA, 20 bp, Artificial Sequence
  Description of Artificial Sequence: Synthetic oligonucleotide
  Target: AGXT; (-) strand; PAM type: NRG; PAM sequence: GGG
tgcatgggaggaggaggctg

SEQ ID NO: 7904 - DNA, 20 bp, Artificial Sequence
  Description of Artificial Sequence: Synthetic oligonucleotide
  Target: AGXT; (-) strand; PAM type: NRG; PAM sequence: GGG
gtgcatgggaggaggaggct

SEQ ID NO: 7905 - DNA, 20 bp, Artificial Sequence
  Description of Artificial Sequence: Synthetic oligonucleotide
  Target: AGXT; (-) strand; PAM type: NRG; PAM sequence: TGG
tgtgcatgggaggaggaggc

SEQ ID NO: 7906 - DNA, 20 bp, Artificial Sequence
  Description of Artificial Sequence: Synthetic oligonucleotide
  Target: AGXT; (-) strand; PAM type: NRG; PAM sequence: AGG
atggtgtgcatgggaggagg

SEQ ID NO: 7907 - DNA, 20 bp, Artificial Sequence
  Description of Artificial Sequence: Synthetic oligonucleotide
  Target: AGXT; (-) strand; PAM type: NRG; PAM sequence: GAG
gatggtgtgcatgggaggag

SEQ ID NO: 7908 - DNA, 20 bp, Artificial Sequence
  Description of Artificial Sequence: Synthetic oligonucleotide
  Target: AGXT; (-) strand; PAM type: NRG; PAM sequence: AGG
ctgatggtgtgcatgggagg

SEQ ID NO: 7909 - DNA, 20 bp, Artificial Sequence
  Description of Artificial Sequence: Synthetic oligonucleotide
  Target: AGXT; (-) strand; PAM type: NRG; PAM sequence: GAG
cctgatggtgtgcatgggag

SEQ ID NO: 7910 - DNA, 20 bp, Artificial Sequence
  Description of Artificial Sequence: Synthetic oligonucleotide
  Target: AGXT; (-) strand; PAM type: NRG; PAM sequence: AGG
tccctgatggtgtgcatggg

SEQ ID NO: 7911 - DNA, 20 bp, Artificial Sequence
  Description of Artificial Sequence: Synthetic oligonucleotide
  Target: AGXT; (-) strand; PAM type: NRG; PAM sequence: GAG
ctccctgatggtgtgcatgg

SEQ ID NO: 7912 - DNA, 20 bp, Artificial Sequence
  Description of Artificial Sequence: Synthetic oligonucleotide
  Target: AGXT; (-) strand; PAM type: NRG; PAM sequence: GGG
tcctccctgatggtgtgcat

SEQ ID NO: 7913 - DNA, 20 bp, Artificial Sequence
  Description of Artificial Sequence: Synthetic oligonucleotide
  Target: AGXT; (-) strand; PAM type: NRG; PAM sequence: TGG
ctcctccctgatggtgtgca

SEQ ID NO: 7914 - DNA, 20 bp, Artificial Sequence
  Description of Artificial Sequence: Synthetic oligonucleotide
  Target: AGXT; (-) strand; PAM type: NRG; PAM sequence: TGG
ctgcctctactcctccctga

SEQ ID NO: 7915 - DNA, 20 bp, Artificial Sequence
  Description of Artificial Sequence: Synthetic oligonucleotide
  Target: AGXT; (-) strand; PAM type: NRG; PAM sequence: GGG
agctccaggtagcaggggct

SEQ ID NO: 7916 - DNA, 20 bp, Artificial Sequence
  Description of Artificial Sequence: Synthetic oligonucleotide
  Target: AGXT; (-) strand; PAM type: NRG; PAM sequence: TGG
cagctccaggtagcaggggc

SEQ ID NO: 7917 - DNA, 20 bp, Artificial Sequence
  Description of Artificial Sequence: Synthetic oligonucleotide
  Target: AGXT; (-) strand; PAM type: NRG; PAM sequence: GGG
ggcacagctccaggtagcag

SEQ ID NO: 7918 - DNA, 20 bp, Artificial Sequence
  Description of Artificial Sequence: Synthetic oligonucleotide
  Target: AGXT; (-) strand; PAM type: NRG; PAM sequence: GGG
tggcacagctccaggtagca

SEQ ID NO: 7919 - DNA, 20 bp, Artificial Sequence
  Description of Artificial Sequence: Synthetic oligonucleotide
  Target: AGXT; (-) strand; PAM type: NRG; PAM sequence: AGG
gtggcacagctccaggtagc

SEQ ID NO: 7920 - DNA, 20 bp, Artificial Sequence
  Description of Artificial Sequence: Synthetic oligonucleotide
  Target: AGXT; (-) strand; PAM type: NRG; PAM sequence: CAG
ggtggcacagctccaggtag

SEQ ID NO: 7921 - DNA, 20 bp, Artificial Sequence
  Description of Artificial Sequence: Synthetic oligonucleotide
  Target: AGXT; (-) strand; PAM type: NRG; PAM sequence: TAG
atgggtggcacagctccagg

SEQ ID NO: 7922 - DNA, 20 bp, Artificial Sequence
  Description of Artificial Sequence: Synthetic oligonucleotide
  Target: AGXT; (-) strand; PAM type: NRG; PAM sequence: AGG
cccatgggtggcacagctcc

SEQ ID NO: 7923 - DNA, 20 bp, Artificial Sequence
  Description of Artificial Sequence: Synthetic oligonucleotide
  Target: AGXT; (-) strand; PAM type: NRG; PAM sequence: CAG
ccccatgggtggcacagctc

SEQ ID NO: 7924 - DNA, 20 bp, Artificial Sequence
  Description of Artificial Sequence: Synthetic oligonucleotide
  Target: AGXT; (-) strand; PAM type: NRG; PAM sequence: CAG
caaaccccccatgggtggca

SEQ ID NO: 7925 - DNA, 20 bp, Artificial Sequence
  Description of Artificial Sequence: Synthetic oligonucleotide
  Target: AGXT; (-) strand; PAM type: NRG; PAM sequence: TGG
ccccacaaaccccccatggg

SEQ ID NO: 7926 - DNA, 20 bp, Artificial Sequence
  Description of Artificial Sequence: Synthetic oligonucleotide
  Target: AGXT; (-) strand; PAM type: NRG; PAM sequence: GGG
cacccccacaaaccccccat

SEQ ID NO: 7927 - DNA, 20 bp, Artificial Sequence
  Description of Artificial Sequence: Synthetic oligonucleotide
  Target: AGXT; (-) strand; PAM type: NRG; PAM sequence: TGG
acacccccacaaacccccca

SEQ ID NO: 7928 - DNA, 20 bp, Artificial Sequence
  Description of Artificial Sequence: Synthetic oligonucleotide
  Target: AGXT; (-) strand; PAM type: NRG; PAM sequence: CAG
gagctcagaggggcaggggc

SEQ ID NO: 7929 - DNA, 20 bp, Artificial Sequence
  Description of Artificial Sequence: Synthetic oligonucleotide
  Target: AGXT; (-) strand; PAM type: NRG; PAM sequence: GGG
ggtggagctcagaggggcag

SEQ ID NO: 7930 - DNA, 20 bp, Artificial Sequence
  Description of Artificial Sequence: Synthetic oligonucleotide
  Target: AGXT; (-) strand; PAM type: NRG; PAM sequence: GGG
gggtggagctcagaggggca

SEQ ID NO: 7931 - DNA, 20 bp, Artificial Sequence
  Description of Artificial Sequence: Synthetic oligonucleotide
  Target: AGXT; (-) strand; PAM type: NRG; PAM sequence: AGG
tgggtggagctcagaggggc

SEQ ID NO: 7932 - DNA, 20 bp, Artificial Sequence
  Description of Artificial Sequence: Synthetic oligonucleotide
  Target: AGXT; (-) strand; PAM type: NRG; PAM sequence: CAG
gtgggtggagctcagagggg

SEQ ID NO: 7933 - DNA, 20 bp, Artificial Sequence
  Description of Artificial Sequence: Synthetic oligonucleotide
  Target: AGXT; (-) strand; PAM type: NRG; PAM sequence: GGG
gctgtgggtggagctcagag

SEQ ID NO: 7934 - DNA, 20 bp, Artificial Sequence
  Description of Artificial Sequence: Synthetic oligonucleotide
  Target: AGXT; (-) strand; PAM type: NRG; PAM sequence: GGG
ggctgtgggtggagctcaga

SEQ ID NO: 7935 - DNA, 20 bp, Artificial Sequence
  Description of Artificial Sequence: Synthetic oligonucleotide
  Target: AGXT; (-) strand; PAM type: NRG; PAM sequence: AGG
cggctgtgggtggagctcag

SEQ ID NO: 7936 - DNA, 20 bp, Artificial Sequence
  Description of Artificial Sequence: Synthetic oligonucleotide
  Target: AGXT; (-) strand; PAM type: NRG; PAM sequence: GAG
acggctgtgggtggagctca

SEQ ID NO: 7937 - DNA, 20 bp, Artificial Sequence
  Description of Artificial Sequence: Synthetic oligonucleotide
  Target: AGXT; (-) strand; PAM type: NRG; PAM sequence: CAG
ggacggctgtgggtggagct

SEQ ID NO: 7938 - DNA, 20 bp, Artificial Sequence
  Description of Artificial Sequence: Synthetic oligonucleotide
  Target: AGXT; (-) strand; PAM type: NRG; PAM sequence: GAG
agcagggacggctgtgggtg

SEQ ID NO: 7939 - DNA, 20 bp, Artificial Sequence
  Description of Artificial Sequence: Synthetic oligonucleotide
  Target: AGXT; (-) strand; PAM type: NRG; PAM sequence: TGG
gaagcagggacggctgtggg

SEQ ID NO: 7940 - DNA, 20 bp, Artificial Sequence
  Description of Artificial Sequence: Synthetic oligonucleotide
  Target: AGXT; (-) strand; PAM type: NRG; PAM sequence: GGG
gaggaagcagggacggctgt

SEQ ID NO: 7941 - DNA, 20 bp, Artificial Sequence
  Description of Artificial Sequence: Synthetic oligonucleotide
  Target: AGXT; (-) strand; PAM type: NRG; PAM sequence: TGG
tgaggaagcagggacggctg

SEQ ID NO: 7942 - DNA, 20 bp, Artificial Sequence
  Description of Artificial Sequence: Synthetic oligonucleotide
  Target: AGXT; (-) strand; PAM type: NRG; PAM sequence: CGG
aggccctgaggaagcaggga

SEQ ID NO: 7943 - DNA, 20 bp, Artificial Sequence
  Description of Artificial Sequence: Synthetic oligonucleotide
  Target: AGXT; (-) strand; PAM type: NRG; PAM sequence: GGG
ggccaggccctgaggaagca

SEQ ID NO: 7944 - DNA, 20 bp, Artificial Sequence
  Description of Artificial Sequence: Synthetic oligonucleotide
  Target: AGXT; (-) strand; PAM type: NRG; PAM sequence: AGG
gggccaggccctgaggaagc

SEQ ID NO: 7945 - DNA, 20 bp, Artificial Sequence
  Description of Artificial Sequence: Synthetic oligonucleotide
  Target: AGXT; (-) strand; PAM type: NRG; PAM sequence: CAG
tgggccaggccctgaggaag

SEQ ID NO: 7946 - DNA, 20 bp, Artificial Sequence
  Description of Artificial Sequence: Synthetic oligonucleotide
  Target: AGXT; (-) strand; PAM type: NRG; PAM sequence: AAG
tgctgggccaggccctgagg

SEQ ID NO: 7947 - DNA, 20 bp, Artificial Sequence
  Description of Artificial Sequence: Synthetic oligonucleotide
  Target: AGXT; (-) strand; PAM type: NRG; PAM sequence: AGG
ttgtgctgggccaggccctg

SEQ ID NO: 7948 - DNA, 20 bp, Artificial Sequence
  Description of Artificial Sequence: Synthetic oligonucleotide
  Target: AGXT; (-) strand; PAM type: NRG; PAM sequence: GAG
cttgtgctgggccaggccct

SEQ ID NO: 7949 - DNA, 20 bp, Artificial Sequence
  Description of Artificial Sequence: Synthetic oligonucleotide
  Target: AGXT; (-) strand; PAM type: NRG; PAM sequence: AGG
gcactggcttgtgctgggcc

SEQ ID NO: 7950 - DNA, 20 bp, Artificial Sequence
  Description of Artificial Sequence: Synthetic oligonucleotide
  Target: AGXT; (-) strand; PAM type: NRG; PAM sequence: CAG
agcactggcttgtgctgggc

SEQ ID NO: 7951 - DNA, 20 bp, Artificial Sequence
  Description of Artificial Sequence: Synthetic oligonucleotide
  Target: AGXT; (-) strand; PAM type: NRG; PAM sequence: GGG
cagcagcactggcttgtgct

SEQ ID NO: 7952 - DNA, 20 bp, Artificial Sequence
  Description of Artificial Sequence: Synthetic oligonucleotide
  Target: AGXT; (-) strand; PAM type: NRG; PAM sequence: TGG
acagcagcactggcttgtgc

SEQ ID NO: 7953 - DNA, 20 bp, Artificial Sequence
  Description of Artificial Sequence: Synthetic oligonucleotide
  Target: AGXT; (-) strand; PAM type: NRG; PAM sequence: TGG
tgggttaagaacagcagcac

SEQ ID NO: 7954 - DNA, 20 bp, Artificial Sequence
  Description of Artificial Sequence: Synthetic oligonucleotide
  Target: AGXT; (-) strand; PAM type: NRG; PAM sequence: CAG
tccccgtgggttaagaacag

SEQ ID NO: 7955 - DNA, 20 bp, Artificial Sequence
  Description of Artificial Sequence: Synthetic oligonucleotide
  Target: AGXT; (-) strand; PAM type: NRG; PAM sequence: CAG
gactccccgtgggttaagaa

SEQ ID NO: 7956 - DNA, 20 bp, Artificial Sequence
  Description of Artificial Sequence: Synthetic oligonucleotide
  Target: AGXT; (-) strand; PAM type: NRG; PAM sequence: AAG
tggacgactccccgtgggtt

SEQ ID NO: 7957 - DNA, 20 bp, Artificial Sequence
  Description of Artificial Sequence: Synthetic oligonucleotide
  Target: AGXT; (-) strand; PAM type: NRG; PAM sequence: GGG
gccggtggacgactccccgt

SEQ ID NO: 7958 - DNA, 20 bp, Artificial Sequence
  Description of Artificial Sequence: Synthetic oligonucleotide
  Target: AGXT; (-) strand; PAM type: NRG; PAM sequence: TGG
cgccggtggacgactccccg

SEQ ID NO: 7959 - DNA, 20 bp, Artificial Sequence
  Description of Artificial Sequence: Synthetic oligonucleotide
  Target: AGXT; (-) strand; PAM type: NRG; PAM sequence: TGG
aaggggctgcagcacgccgg

SEQ ID NO: 7960 - DNA, 20 bp, Artificial Sequence
  Description of Artificial Sequence: Synthetic oligonucleotide
  Target: AGXT; (-) strand; PAM type: NRG; PAM sequence: CGG
atcaaggggctgcagcacgc

SEQ ID NO: 7961 - DNA, 20 bp, Artificial Sequence
  Description of Artificial Sequence: Synthetic oligonucleotide
  Target: AGXT; (-) strand; PAM type: NRG; PAM sequence: CAG
ccgaagccatcaaggggctg

SEQ ID NO: 7962 - DNA, 20 bp, Artificial Sequence
  Description of Artificial Sequence: Synthetic oligonucleotide
  Target: AGXT; (-) strand; PAM type: NRG; PAM sequence: GGG
agttccccgaagccatcaag

SEQ ID NO: 7963 - DNA, 20 bp, Artificial Sequence
  Description of Artificial Sequence: Synthetic oligonucleotide
  Target: AGXT; (-) strand; PAM type: NRG; PAM sequence: GGG
gagttccccgaagccatcaa

SEQ ID NO: 7964 - DNA, 20 bp, Artificial Sequence
  Description of Artificial Sequence: Synthetic oligonucleotide
  Target: AGXT; (-) strand; PAM type: NRG; PAM sequence: AGG
agagttccccgaagccatca

SEQ ID NO: 7965 - DNA, 20 bp, Artificial Sequence
  Description of Artificial Sequence: Synthetic oligonucleotide
  Target: AGXT; (-) strand; PAM type: NRG; PAM sequence: AAG
cagagttccccgaagccatc

SEQ ID NO: 7966 - DNA, 20 bp, Artificial Sequence
  Description of Artificial Sequence: Synthetic oligonucleotide
  Target: AGXT; (-) strand; PAM type: NRG; PAM sequence: AAG
acctgtggcagagttccccg

SEQ ID NO: 7967 - DNA, 20 bp, Artificial Sequence
  Description of Artificial Sequence: Synthetic oligonucleotide
  Target: AGXT; (-) strand; PAM type: NRG; PAM sequence: GAG
ggccaggctcacctgtggca

SEQ ID NO: 7968 - DNA, 20 bp, Artificial Sequence
  Description of Artificial Sequence: Synthetic oligonucleotide
  Target: AGXT; (-) strand; PAM type: NRG; PAM sequence: CAG
ggggccaggctcacctgtgg

SEQ ID NO: 7969 - DNA, 20 bp, Artificial Sequence
  Description of Artificial Sequence: Synthetic oligonucleotide
  Target: AGXT; (-) strand; PAM type: NRG; PAM sequence: TGG
cctggggccaggctcacctg

SEQ ID NO: 7970 - DNA, 20 bp, Artificial Sequence
  Description of Artificial Sequence: Synthetic oligonucleotide
  Target: AGXT; (-) strand; PAM type: NRG; PAM sequence: AGG
cagtccaccgccctggggcc

SEQ ID NO: 7971 - DNA, 20 bp, Artificial Sequence
  Description of Artificial Sequence: Synthetic oligonucleotide
  Target: AGXT; (-) strand; PAM type: NRG; PAM sequence: CAG
ccagtccaccgccctggggc

SEQ ID NO: 7972 - DNA, 20 bp, Artificial Sequence
  Description of Artificial Sequence: Synthetic oligonucleotide
  Target: AGXT; (-) strand; PAM type: NRG; PAM sequence: GGG
tgctccagtccaccgccctg

SEQ ID NO: 7973 - DNA, 20 bp, Artificial Sequence
  Description of Artificial Sequence: Synthetic oligonucleotide
  Target: AGXT; (-) strand; PAM type: NRG; PAM sequence: GGG
gtgctccagtccaccgccct

SEQ ID NO: 7974 - DNA, 20 bp, Artificial Sequence
  Description of Artificial Sequence: Synthetic oligonucleotide
  Target: AGXT; (-) strand; PAM type: NRG; PAM sequence: TGG
tgtgctccagtccaccgccc

SEQ ID NO: 7975 - DNA, 20 bp, Artificial Sequence
  Description of Artificial Sequence: Synthetic oligonucleotide
  Target: AGXT; (-) strand; PAM type: NRG; PAM sequence: CAG
cctggctctgagctgtgctc

SEQ ID NO: 7976 - DNA, 20 bp, Artificial Sequence
  Description of Artificial Sequence: Synthetic oligonucleotide
  Target: AGXT; (-) strand; PAM type: NRG; PAM sequence: GAG
cctccccatagcctggctct

SEQ ID NO: 7977 - DNA, 20 bp, Artificial Sequence
  Description of Artificial Sequence: Synthetic oligonucleotide
  Target: AGXT; (-) strand; PAM type: NRG; PAM sequence: TGG
gcccacccctccccatagcc

SEQ ID NO: 7978 - DNA, 20 bp, Artificial Sequence
  Description of Artificial Sequence: Synthetic oligonucleotide
  Target: AGXT; (-) strand; PAM type: NRG; PAM sequence: TAG
ccagtgcccacccctcccca

SEQ ID NO: 7979 - DNA, 20 bp, Artificial Sequence
  Description of Artificial Sequence: Synthetic oligonucleotide
  Target: AGXT; (-) strand; PAM type: NRG; PAM sequence: CAG
ggcagaaggaccagagggac

SEQ ID NO: 7980 - DNA, 20 bp, Artificial Sequence
  Description of Artificial Sequence: Synthetic oligonucleotide
  Target: AGXT; (-) strand; PAM type: NRG; PAM sequence: GGG
ccaggggcagaaggaccaga

SEQ ID NO: 7981 - DNA, 20 bp, Artificial Sequence
  Description of Artificial Sequence: Synthetic oligonucleotide
  Target: AGXT; (-) strand; PAM type: NRG; PAM sequence: AGG
accaggggcagaaggaccag

SEQ ID NO: 7982 - DNA, 20 bp, Artificial Sequence
  Description of Artificial Sequence: Synthetic oligonucleotide
  Target: AGXT; (-) strand; PAM type: NRG; PAM sequence: GAG
gaccaggggcagaaggacca

SEQ ID NO: 7983 - DNA, 20 bp, Artificial Sequence
  Description of Artificial Sequence: Synthetic oligonucleotide
  Target: AGXT; (-) strand; PAM type: NRG; PAM sequence: CAG
gggaccaggggcagaaggac

SEQ ID NO: 7984 - DNA, 20 bp, Artificial Sequence
  Description of Artificial Sequence: Synthetic oligonucleotide
  Target: AGXT; (-) strand; PAM type: NRG; PAM sequence: AGG
gggtggggaccaggggcaga

SEQ ID NO: 7985 - DNA, 20 bp, Artificial Sequence
  Description of Artificial Sequence: Synthetic oligonucleotide
  Target: AGXT; (-) strand; PAM type: NRG; PAM sequence: AAG
ggggtggggaccaggggcag

SEQ ID NO: 7986 - DNA, 20 bp, Artificial Sequence
  Description of Artificial Sequence: Synthetic oligonucleotide
  Target: AGXT; (-) strand; PAM type: NRG; PAM sequence: CAG
gctggggtggggaccagggg

SEQ ID NO: 7987 - DNA, 20 bp, Artificial Sequence
  Description of Artificial Sequence: Synthetic oligonucleotide
  Target: AGXT; (-) strand; PAM type: NRG; PAM sequence: GGG
gaggctggggtggggaccag

SEQ ID NO: 7988 - DNA, 20 bp, Artificial Sequence
  Description of Artificial Sequence: Synthetic oligonucleotide
  Target: AGXT; (-) strand; PAM type: NRG; PAM sequence: GGG
agaggctggggtggggacca

SEQ ID NO: 7989 - DNA, 20 bp, Artificial Sequence
  Description of Artificial Sequence: Synthetic oligonucleotide
  Target: AGXT; (-) strand; PAM type: NRG; PAM sequence: AGG
cagaggctggggtggggacc

SEQ ID NO: 7990 - DNA, 20 bp, Artificial Sequence
  Description of Artificial Sequence: Synthetic oligonucleotide
  Target: AGXT; (-) strand; PAM type: NRG; PAM sequence: CAG
acagaggctggggtggggac

SEQ ID NO: 7991 - DNA, 20 bp, Artificial Sequence
  Description of Artificial Sequence: Synthetic oligonucleotide
  Target: AGXT; (-) strand; PAM type: NRG; PAM sequence: GGG
atgtgacagaggctggggtg

SEQ ID NO: 7992 - DNA, 20 bp, Artificial Sequence
  Description of Artificial Sequence: Synthetic oligonucleotide
  Target: AGXT; (-) strand; PAM type: NRG; PAM sequence: GGG
catgtgacagaggctggggt

SEQ ID NO: 7993 - DNA, 20 bp, Artificial Sequence
  Description of Artificial Sequence: Synthetic oligonucleotide
  Target: AGXT; (-) strand; PAM type: NRG; PAM sequence: TGG
ccatgtgacagaggctgggg

SEQ ID NO: 7994 - DNA, 20 bp, Artificial Sequence
  Description of Artificial Sequence: Synthetic oligonucleotide
  Target: AGXT; (-) strand; PAM type: NRG; PAM sequence: GGG
ataccatgtgacagaggctg

SEQ ID NO: 7995 - DNA, 20 bp, Artificial Sequence
  Description of Artificial Sequence: Synthetic oligonucleotide
  Target: AGXT; (-) strand; PAM type: NRG; PAM sequence: GGG
cataccatgtgacagaggct

SEQ ID NO: 7996 - DNA, 20 bp, Artificial Sequence
  Description of Artificial Sequence: Synthetic oligonucleotide
  Target: AGXT; (-) strand; PAM type: NRG; PAM sequence: TGG
ccataccatgtgacagaggc

SEQ ID NO: 7997 - DNA, 20 bp, Artificial Sequence
  Description of Artificial Sequence: Synthetic oligonucleotide
  Target: AGXT; (-) strand; PAM type: NRG; PAM sequence: AGG
caccccataccatgtgacag

SEQ ID NO: 7998 - DNA, 20 bp, Artificial Sequence
  Description of Artificial Sequence: Synthetic oligonucleotide
  Target: AGXT; (-) strand; PAM type: NRG; PAM sequence: GAG
gcaccccataccatgtgaca

SEQ ID NO: 7999 - DNA, 20 bp, Artificial Sequence
  Description of Artificial Sequence: Synthetic oligonucleotide
  Target: AGXT; (-) strand; PAM type: NRG; PAM sequence: CAG
ctgcaccccataccatgtga

SEQ ID NO: 8000 - DNA, 20 bp, Artificial Sequence
  Description of Artificial Sequence: Synthetic oligonucleotide
  Target: AGXT; (-) strand; PAM type: NRG; PAM sequence: AGG
cagagcaaagaggacctggg

SEQ ID NO: 8001 - DNA, 20 bp, Artificial Sequence
  Description of Artificial Sequence: Synthetic oligonucleotide
  Target: AGXT; (-) strand; PAM type: NRG; PAM sequence: GAG
ccagagcaaagaggacctgg

SEQ ID NO: 8002 - DNA, 20 bp, Artificial Sequence
  Description of Artificial Sequence: Synthetic oligonucleotide
  Target: AGXT; (-) strand; PAM type: NRG; PAM sequence: GGG
gcccagagcaaagaggacct

SEQ ID NO: 8003 - DNA, 20 bp, Artificial Sequence
  Description of Artificial Sequence: Synthetic oligonucleotide
  Target: AGXT; (-) strand; PAM type: NRG; PAM sequence: TGG
agcccagagcaaagaggacc

SEQ ID NO: 8004 - DNA, 20 bp, Artificial Sequence
  Description of Artificial Sequence: Synthetic oligonucleotide
  Target: AGXT; (-) strand; PAM type: NRG; PAM sequence: AGG
agactcagcccagagcaaag

SEQ ID NO: 8005 - DNA, 20 bp, Artificial Sequence
  Description of Artificial Sequence: Synthetic oligonucleotide
  Target: AGXT; (-) strand; PAM type: NRG; PAM sequence: GAG
tagactcagcccagagcaaa

SEQ ID NO: 8006 - DNA, 20 bp, Artificial Sequence
  Description of Artificial Sequence: Synthetic oligonucleotide
  Target: AGXT; (-) strand; PAM type: NRG; PAM sequence: AAG
tttagactcagcccagagca

SEQ ID NO: 8007 - DNA, 20 bp, Artificial Sequence
  Description of Artificial Sequence: Synthetic oligonucleotide
  Target: AGXT; (-) strand; PAM type: NRG; PAM sequence: GAG
ttgtctttagactcagccca

SEQ ID NO: 8008 - DNA, 20 bp, Artificial Sequence
  Description of Artificial Sequence: Synthetic oligonucleotide
  Target: AGXT; (-) strand; PAM type: NRG; PAM sequence: CAG
ggttgtctttagactcagcc

SEQ ID NO: 8009 - DNA, 20 bp, Artificial Sequence
  Description of Artificial Sequence: Synthetic oligonucleotide
  Target: AGXT; (-) strand; PAM type: NRG; PAM sequence: CAG
cctggggttgtctttagact

SEQ ID NO: 8010 - DNA, 20 bp, Artificial Sequence
  Description of Artificial Sequence: Synthetic oligonucleotide
  Target: AGXT; (-) strand; PAM type: NRG; PAM sequence: TAG
ctgggacctggggttgtctt

SEQ ID NO: 8011 - DNA, 20 bp, Artificial Sequence
  Description of Artificial Sequence: Synthetic oligonucleotide
  Target: AGXT; (-) strand; PAM type: NRG; PAM sequence: GGG
tgagcctgccctgggacctg

SEQ ID NO: 8012 - DNA, 20 bp, Artificial Sequence
  Description of Artificial Sequence: Synthetic oligonucleotide
  Target: AGXT; (-) strand; PAM type: NRG; PAM sequence: GGG
ctgagcctgccctgggacct

SEQ ID NO: 8013 - DNA, 20 bp, Artificial Sequence
  Description of Artificial Sequence: Synthetic oligonucleotide
  Target: AGXT; (-) strand; PAM type: NRG; PAM sequence: TGG
cctgagcctgccctgggacc

SEQ ID NO: 8014 - DNA, 20 bp, Artificial Sequence
  Description of Artificial Sequence: Synthetic oligonucleotide
  Target: AGXT; (-) strand; PAM type: NRG; PAM sequence: GGG
ggagcacctgagcctgccct

SEQ ID NO: 8015 - DNA, 20 bp, Artificial Sequence
  Description of Artificial Sequence: Synthetic oligonucleotide
  Target: AGXT; (-) strand; PAM type: NRG; PAM sequence: TGG
gggagcacctgagcctgccc

SEQ ID NO: 8016 - DNA, 20 bp, Artificial Sequence
  Description of Artificial Sequence: Synthetic oligonucleotide
  Target: AGXT; (-) strand; PAM type: NRG; PAM sequence: GAG
cgctcggccagggagcacct

SEQ ID NO: 8017 - DNA, 20 bp, Artificial Sequence
  Description of Artificial Sequence: Synthetic oligonucleotide
  Target: AGXT; (-) strand; PAM type: NRG; PAM sequence: GAG
tatgggggcgctcggccagg

SEQ ID NO: 8018 - DNA, 20 bp, Artificial Sequence
  Description of Artificial Sequence: Synthetic oligonucleotide
  Target: AGXT; (-) strand; PAM type: NRG; PAM sequence: GGG
actatgggggcgctcggcca

SEQ ID NO: 8019 - DNA, 20 bp, Artificial Sequence
  Description of Artificial Sequence: Synthetic oligonucleotide
  Target: AGXT; (-) strand; PAM type: NRG; PAM sequence: AGG
cactatgggggcgctcggcc

SEQ ID NO: 8020 - DNA, 20 bp, Artificial Sequence
  Description of Artificial Sequence: Synthetic oligonucleotide
  Target: AGXT; (-) strand; PAM type: NRG; PAM sequence: CAG
gcactatgggggcgctcggc

SEQ ID NO: 8021 - DNA, 20 bp, Artificial Sequence
  Description of Artificial Sequence: Synthetic oligonucleotide
  Target: AGXT; (-) strand; PAM type: NRG; PAM sequence: CGG
gtgggcactatgggggcgct

SEQ ID NO: 8022 - DNA, 20 bp, Artificial Sequence
  Description of Artificial Sequence: Synthetic oligonucleotide
  Target: AGXT; (-) strand; PAM type: NRG; PAM sequence: GGG
gaggtcagtgggcactatgg

SEQ ID NO: 8023 - DNA, 20 bp, Artificial Sequence
  Description of Artificial Sequence: Synthetic oligonucleotide
  Target: AGXT; (-) strand; PAM type: NRG; PAM sequence: GGG
agaggtcagtgggcactatg

SEQ ID NO: 8024 - DNA, 20 bp, Artificial Sequence
  Description of Artificial Sequence: Synthetic oligonucleotide
  Target: AGXT; (-) strand; PAM type: NRG; PAM sequence: GGG
cagaggtcagtgggcactat

SEQ ID NO: 8025 - DNA, 20 bp, Artificial Sequence
  Description of Artificial Sequence: Synthetic oligonucleotide
  Target: AGXT; (-) strand; PAM type: NRG; PAM sequence: TGG
acagaggtcagtgggcacta

SEQ ID NO: 8026 - DNA, 20 bp, Artificial Sequence
  Description of Artificial Sequence: Synthetic oligonucleotide
  Target: AGXT; (-) strand; PAM type: NRG; PAM sequence: GGG
ccctggggacagaggtcagt

SEQ ID NO: 8027 - DNA, 20 bp, Artificial Sequence
  Description of Artificial Sequence: Synthetic oligonucleotide
  Target: AGXT; (-) strand; PAM type: NRG; PAM sequence: TGG
gccctggggacagaggtcag

SEQ ID NO: 8028 - DNA, 20 bp, Artificial Sequence
  Description of Artificial Sequence: Synthetic oligonucleotide
  Target: AGXT; (-) strand; PAM type: NRG; PAM sequence: CAG
tcagccctggggacagaggt

SEQ ID NO: 8029 - DNA, 20 bp, Artificial Sequence
  Description of Artificial Sequence: Synthetic oligonucleotide
  Target: AGXT; (-) strand; PAM type: NRG; PAM sequence: AGG
ctcttcagccctggggacag

SEQ ID NO: 8030 - DNA, 20 bp, Artificial Sequence
  Description of Artificial Sequence: Synthetic oligonucleotide
  Target: AGXT; (-) strand; PAM type: NRG; PAM sequence: GAG
cctcttcagccctggggaca

SEQ ID NO: 8031 - DNA, 20 bp, Artificial Sequence
  Description of Artificial Sequence: Synthetic oligonucleotide
  Target: AGXT; (-) strand; PAM type: NRG; PAM sequence: CAG
gccctcttcagccctgggga

SEQ ID NO: 8032 - DNA, 20 bp, Artificial Sequence
  Description of Artificial Sequence: Synthetic oligonucleotide
  Target: AGXT; (-) strand; PAM type: NRG; PAM sequence: GGG
ccaagccctcttcagccctg

SEQ ID NO: 8033 - DNA, 20 bp, Artificial Sequence
  Description of Artificial Sequence: Synthetic oligonucleotide
  Target: AGXT; (-) strand; PAM type: NRG; PAM sequence: GGG
accaagccctcttcagccct

SEQ ID NO: 8034 - DNA, 20 bp, Artificial Sequence
  Description of Artificial Sequence: Synthetic oligonucleotide
  Target: AGXT; (-) strand; PAM type: NRG; PAM sequence: TGG
caccaagccctcttcagccc

SEQ ID NO: 8035 - DNA, 20 bp, Artificial Sequence
  Description of Artificial Sequence: Synthetic oligonucleotide
  Target: AGXT; (-) strand; PAM type: NRG; PAM sequence: CAG
agtctgcaccaagccctctt

SEQ ID NO: 8036 - DNA, 20 bp, Artificial Sequence
  Description of Artificial Sequence: Synthetic oligonucleotide
  Target: AGXT; (-) strand; PAM type: NRG; PAM sequence: AAG
aagatatggaagtctgcacc

SEQ ID NO: 8037 - DNA, 20 bp, Artificial Sequence
  Description of Artificial Sequence: Synthetic oligonucleotide
  Target: AGXT; (-) strand; PAM type: NRG; PAM sequence: AAG
caggccctggcaagatatgg

SEQ ID NO: 8038 - DNA, 20 bp, Artificial Sequence
  Description of Artificial Sequence: Synthetic oligonucleotide
  Target: AGXT; (-) strand; PAM type: NRG; PAM sequence: TGG
ggacaggccctggcaagata

SEQ ID NO: 8039 - DNA, 20 bp, Artificial Sequence
  Description of Artificial Sequence: Synthetic oligonucleotide
  Target: AGXT; (-) strand; PAM type: NRG; PAM sequence: AAG
aggtggggacaggccctggc

SEQ ID NO: 8040 - DNA, 20 bp, Artificial Sequence
  Description of Artificial Sequence: Synthetic oligonucleotide
  Target: AGXT; (-) strand; PAM type: NRG; PAM sequence: TGG
ggtgaggtggggacaggccc

SEQ ID NO: 8041 - DNA, 20 bp, Artificial Sequence
  Description of Artificial Sequence: Synthetic oligonucleotide
  Target: AGXT; (-) strand; PAM type: NRG; PAM sequence: AGG
tctcggggtgaggtggggac

SEQ ID NO: 8042 - DNA, 20 bp, Artificial Sequence
  Description of Artificial Sequence: Synthetic oligonucleotide
  Target: AGXT; (-) strand; PAM type: NRG; PAM sequence: CAG
atctcggggtgaggtgggga

SEQ ID NO: 8043 - DNA, 20 bp, Artificial Sequence
  Description of Artificial Sequence: Synthetic oligonucleotide
  Target: AGXT; (-) strand; PAM type: NRG; PAM sequence: GGG
ggcaatctcggggtgaggtg

SEQ ID NO: 8044 - DNA, 20 bp, Artificial Sequence
  Description of Artificial Sequence: Synthetic oligonucleotide
  Target: AGXT; (-) strand; PAM type: NRG; PAM sequence: GGG
tggcaatctcggggtgaggt

SEQ ID NO: 8045 - DNA, 20 bp, Artificial Sequence
  Description of Artificial Sequence: Synthetic oligonucleotide
  Target: AGXT; (-) strand; PAM type: NRG; PAM sequence: TGG
ctggcaatctcggggtgagg

SEQ ID NO: 8046 - DNA, 20 bp, Artificial Sequence
  Description of Artificial Sequence: Synthetic oligonucleotide
  Target: AGXT; (-) strand; PAM type: NRG; PAM sequence: AGG
gtcctggcaatctcggggtg

SEQ ID NO: 8047 - DNA, 20 bp, Artificial Sequence
  Description of Artificial Sequence: Synthetic oligonucleotide
  Target: AGXT; (-) strand; PAM type: NRG; PAM sequence: GAG
tgtcctggcaatctcggggt

SEQ ID NO: 8048 - DNA, 20 bp, Artificial Sequence
  Description of Artificial Sequence: Synthetic oligonucleotide
  Target: AGXT; (-) strand; PAM type: NRG; PAM sequence: GGG
ttagtgtcctggcaatctcg

SEQ ID NO: 8049 - DNA, 20 bp, Artificial Sequence
  Description of Artificial Sequence: Synthetic oligonucleotide
  Target: AGXT; (-) strand; PAM type: NRG; PAM sequence: GGG
tttagtgtcctggcaatctc

SEQ ID NO: 8050 - DNA, 20 bp, Artificial Sequence
  Description of Artificial Sequence: Synthetic oligonucleotide
  Target: AGXT; (-) strand; PAM type: NRG; PAM sequence: CGG
ctttagtgtcctggcaatct

SEQ ID NO: 8051 - DNA, 20 bp, Artificial Sequence
  Description of Artificial Sequence: Synthetic oligonucleotide
  Target: AGXT; (-) strand; PAM type: NRG; PAM sequence: TGG
atcaggcagctttagtgtcc

SEQ ID NO: 8052 - DNA, 20 bp, Artificial Sequence
  Description of Artificial Sequence: Synthetic oligonucleotide
  Target: AGXT; (-) strand; PAM type: NRG; PAM sequence: TAG
tggagggcatcaggcagctt

SEQ ID NO: 8053 - DNA, 20 bp, Artificial Sequence
  Description of Artificial Sequence: Synthetic oligonucleotide
  Target: AGXT; (-) strand; PAM type: NRG; PAM sequence: CAG
gggaagtggagggcatcagg

SEQ ID NO: 8054 - DNA, 20 bp, Artificial Sequence
  Description of Artificial Sequence: Synthetic oligonucleotide
  Target: AGXT; (-) strand; PAM type: NRG; PAM sequence: AGG
ggagggaagtggagggcatc

SEQ ID NO: 8055 - DNA, 20 bp, Artificial Sequence
  Description of Artificial Sequence: Synthetic oligonucleotide
  Target: AGXT; (-) strand; PAM type: NRG; PAM sequence: CAG
aggagggaagtggagggcat

SEQ ID NO: 8056 - DNA, 20 bp, Artificial Sequence
  Description of Artificial Sequence: Synthetic oligonucleotide
  Target: AGXT; (-) strand; PAM type: NRG; PAM sequence: GGG
ggctggaggagggaagtgga

SEQ ID NO: 8057 - DNA, 20 bp, Artificial Sequence
  Description of Artificial Sequence: Synthetic oligonucleotide
  Target: AGXT; (-) strand; PAM type: NRG; PAM sequence: AGG
aggctggaggagggaagtgg

SEQ ID NO: 8058 - DNA, 20 bp, Artificial Sequence
  Description of Artificial Sequence: Synthetic oligonucleotide
  Target: AGXT; (-) strand; PAM type: NRG; PAM sequence: GAG
gaggctggaggagggaagtg

SEQ ID NO: 8059 - DNA, 20 bp, Artificial Sequence
  Description of Artificial Sequence: Synthetic oligonucleotide
  Target: AGXT; (-) strand; PAM type: NRG; PAM sequence: TGG
gggaggctggaggagggaag

SEQ ID NO: 8060 - DNA, 20 bp, Artificial Sequence
  Description of Artificial Sequence: Synthetic oligonucleotide
  Target: AGXT; (-) strand; PAM type: NRG; PAM sequence: AAG
tgagggaggctggaggaggg

SEQ ID NO: 8061 - DNA, 20 bp, Artificial Sequence
  Description of Artificial Sequence: Synthetic oligonucleotide
  Target: AGXT; (-) strand; PAM type: NRG; PAM sequence: GGG
ggatgagggaggctggagga

SEQ ID NO: 8062 - DNA, 20 bp, Artificial Sequence
  Description of Artificial Sequence: Synthetic oligonucleotide
  Target: AGXT; (-) strand; PAM type: NRG; PAM sequence: AGG
gggatgagggaggctggagg

SEQ ID NO: 8063 - DNA, 20 bp, Artificial Sequence
  Description of Artificial Sequence: Synthetic oligonucleotide
  Target: AGXT; (-) strand; PAM type: NRG; PAM sequence: GAG
ggggatgagggaggctggag

SEQ ID NO: 8064 - DNA, 20 bp, Artificial Sequence
  Description of Artificial Sequence: Synthetic oligonucleotide
  Target: AGXT; (-) strand; PAM type: NRG; PAM sequence: AGG
gcggggatgagggaggctgg

SEQ ID NO: 8065 - DNA, 20 bp, Artificial Sequence
  Description of Artificial Sequence: Synthetic oligonucleotide
  Target: AGXT; (-) strand; PAM type: NRG; PAM sequence: GAG
tgcggggatgagggaggctg

SEQ ID NO: 8066 - DNA, 20 bp, Artificial Sequence
  Description of Artificial Sequence: Synthetic oligonucleotide
  Target: AGXT; (-) strand; PAM type: NRG; PAM sequence: TGG
catgcggggatgagggaggc

SEQ ID NO: 8067 - DNA, 20 bp, Artificial Sequence
  Description of Artificial Sequence: Synthetic oligonucleotide
  Target: AGXT; (-) strand; PAM type: NRG; PAM sequence: AGG
cccccatgcggggatgaggg

SEQ ID NO: 8068 - DNA, 20 bp, Artificial Sequence
  Description of Artificial Sequence: Synthetic oligonucleotide
  Target: AGXT; (-) strand; PAM type: NRG; PAM sequence: GAG
acccccatgcggggatgagg

SEQ ID NO: 8069 - DNA, 20 bp, Artificial Sequence
  Description of Artificial Sequence: Synthetic oligonucleotide
  Target: AGXT; (-) strand; PAM type: NRG; PAM sequence: GGG
gcacccccatgcggggatga

SEQ ID NO: 8070 - DNA, 20 bp, Artificial Sequence
  Description of Artificial Sequence: Synthetic oligonucleotide
  Target: AGXT; (-) strand; PAM type: NRG; PAM sequence: AGG
tgcacccccatgcggggatg

SEQ ID NO: 8071 - DNA, 20 bp, Artificial Sequence
  Description of Artificial Sequence: Synthetic oligonucleotide
  Target: AGXT; (-) strand; PAM type: NRG; PAM sequence: GAG
gtgcacccccatgcggggat

SEQ ID NO: 8072 - DNA, 20 bp, Artificial Sequence
  Description of Artificial Sequence: Synthetic oligonucleotide
  Target: AGXT; (-) strand; PAM type: NRG; PAM sequence: GGG
gccctgtgcacccccatgcg

SEQ ID NO: 8073 - DNA, 20 bp, Artificial Sequence
  Description of Artificial Sequence: Synthetic oligonucleotide
  Target: AGXT; (-) strand; PAM type: NRG; PAM sequence: GGG
tgccctgtgcacccccatgc

SEQ ID NO: 8074 - DNA, 20 bp, Artificial Sequence
  Description of Artificial Sequence: Synthetic oligonucleotide
  Target: AGXT; (-) strand; PAM type: NRG; PAM sequence: CGG
ttgccctgtgcacccccatg

SEQ ID NO: 8075 - DNA, 20 bp, Artificial Sequence
  Description of Artificial Sequence: Synthetic oligonucleotide
  Target: AGXT; (-) strand; PAM type: NRG; PAM sequence: AGG
atcccatctgactccattca

SEQ ID NO: 8076 - DNA, 20 bp, Artificial Sequence
  Description of Artificial Sequence: Synthetic oligonucleotide
  Target: AGXT; (-) strand; PAM type: NRG; PAM sequence: AAG
aatcccatctgactccattc

SEQ ID NO: 8077 - DNA, 20 bp, Artificial Sequence
  Description of Artificial Sequence: Synthetic oligonucleotide
  Target: AGXT; (-) strand; PAM type: NRG; PAM sequence: AGG
gggctctgtccgcatttctc

SEQ ID NO: 8078 - DNA, 20 bp, Artificial Sequence
  Description of Artificial Sequence: Synthetic oligonucleotide
  Target: AGXT; (-) strand; PAM type: NRG; PAM sequence: CAG
ggggctctgtccgcatttct

SEQ ID NO: 8079 - DNA, 20 bp, Artificial Sequence
  Description of Artificial Sequence: Synthetic oligonucleotide
  Target: AGXT; (-) strand; PAM type: NRG; PAM sequence: GGG
cgggactgctgggtcccaag

SEQ ID NO: 8080 - DNA, 20 bp, Artificial Sequence
  Description of Artificial Sequence: Synthetic oligonucleotide
  Target: AGXT; (-) strand; PAM type: NRG; PAM sequence: GGG
acgggactgctgggtcccaa

SEQ ID NO: 8081 - DNA, 20 bp, Artificial Sequence
  Description of Artificial Sequence: Synthetic oligonucleotide
  Target: AGXT; (-) strand; PAM type: NRG; PAM sequence: AGG
gacgggactgctgggtccca

SEQ ID NO: 8082 - DNA, 20 bp, Artificial Sequence
  Description of Artificial Sequence: Synthetic oligonucleotide
  Target: AGXT; (-) strand; PAM type: NRG; PAM sequence: AAG
agacgggactgctgggtccc

SEQ ID NO: 8083 - DNA, 20 bp, Artificial Sequence
  Description of Artificial Sequence: Synthetic oligonucleotide
  Target: AGXT; (-) strand; PAM type: NRG; PAM sequence: GGG
gacctgcagacgggactgct

SEQ ID NO: 8084 - DNA, 20 bp, Artificial Sequence
  Description of Artificial Sequence: Synthetic oligonucleotide
  Target: AGXT; (-) strand; PAM type: NRG; PAM sequence: TGG
agacctgcagacgggactgc

SEQ ID NO: 8085 - DNA, 20 bp, Artificial Sequence
  Description of Artificial Sequence: Synthetic oligonucleotide
  Target: AGXT; (-) strand; PAM type: NRG; PAM sequence: GGG
ctgtgctcagacctgcagac

SEQ ID NO: 8086 - DNA, 20 bp, Artificial Sequence
  Description of Artificial Sequence: Synthetic oligonucleotide
  Target: AGXT; (-) strand; PAM type: NRG; PAM sequence: CGG
cctgtgctcagacctgcaga

SEQ ID NO: 8087 - DNA, 20 bp, Artificial Sequence
  Description of Artificial Sequence: Synthetic oligonucleotide
  Target: AGXT; (-) strand; PAM type: NRG; PAM sequence: CAG
ctgtcctgtgctcagacctg

SEQ ID NO: 8088 - DNA, 20 bp, Artificial Sequence
  Description of Artificial Sequence: Synthetic oligonucleotide
  Target: AGXT; (-) strand; PAM type: NRG; PAM sequence: CAG
tctctcctctgtcctgtgct

SEQ ID NO: 8089 - DNA, 20 bp, Artificial Sequence
  Description of Artificial Sequence: Synthetic oligonucleotide
  Target: AGXT; (-) strand; PAM type: NRG; PAM sequence: GAG
aaggaccctccctggccgtg

SEQ ID NO: 8090 - DNA, 20 bp, Artificial Sequence
  Description of Artificial Sequence: Synthetic oligonucleotide
  Target: AGXT; (-) strand; PAM type: NRG; PAM sequence: TGG
agaaggaccctccctggccg

SEQ ID NO: 8091 - DNA, 20 bp, Artificial Sequence
  Description of Artificial Sequence: Synthetic oligonucleotide
  Target: AGXT; (-) strand; PAM type: NRG; PAM sequence: TGG
cctgtcagaaggaccctccc

SEQ ID NO: 8092 - DNA, 20 bp, Artificial Sequence
  Description of Artificial Sequence: Synthetic oligonucleotide
  Target: AGXT; (-) strand; PAM type: NRG; PAM sequence: AGG
gggctgggggccctgtcaga

SEQ ID NO: 8093 - DNA, 20 bp, Artificial Sequence
  Description of Artificial Sequence: Synthetic oligonucleotide
  Target: AGXT; (-) strand; PAM type: NRG; PAM sequence: AAG
tgggctgggggccctgtcag

SEQ ID NO: 8094 - DNA, 20 bp, Artificial Sequence
  Description of Artificial Sequence: Synthetic oligonucleotide
  Target: AGXT; (-) strand; PAM type: NRG; PAM sequence: CAG
gtctgggctgggggccctgt

SEQ ID NO: 8095 - DNA, 20 bp, Artificial Sequence
  Description of Artificial Sequence: Synthetic oligonucleotide
  Target: AGXT; (-) strand; PAM type: NRG; PAM sequence: GGG
cagcaagctgtctgggctgg

SEQ ID NO: 8096 - DNA, 20 bp, Artificial Sequence
  Description of Artificial Sequence: Synthetic oligonucleotide
  Target: AGXT; (-) strand; PAM type: NRG; PAM sequence: GGG
gcagcaagctgtctgggctg

SEQ ID NO: 8097 - DNA, 20 bp, Artificial Sequence
  Description of Artificial Sequence: Synthetic oligonucleotide
  Target: AGXT; (-) strand; PAM type: NRG; PAM sequence: GGG
tgcagcaagctgtctgggct

SEQ ID NO: 8098 - DNA, 20 bp, Artificial Sequence
  Description of Artificial Sequence: Synthetic oligonucleotide
  Target: AGXT; (-) strand; PAM type: NRG; PAM sequence: TGG
atgcagcaagctgtctgggc

SEQ ID NO: 8099 - DNA, 20 bp, Artificial Sequence
  Description of Artificial Sequence: Synthetic oligonucleotide
  Target: AGXT; (-) strand; PAM type: NRG; PAM sequence: GGG
gtccatgcagcaagctgtct

SEQ ID NO: 8100 - DNA, 20 bp, Artificial Sequence
  Description of Artificial Sequence: Synthetic oligonucleotide
  Target: AGXT; (-) strand; PAM type: NRG; PAM sequence: TGG
ggtccatgcagcaagctgtc

SEQ ID NO: 8101 - DNA, 20 bp, Artificial Sequence
  Description of Artificial Sequence: Synthetic oligonucleotide
  Target: AGXT; (-) strand; PAM type: NRG; PAM sequence: AAG
atggccacggtccatgcagc

SEQ ID NO: 8102 - DNA, 20 bp, Artificial Sequence
  Description of Artificial Sequence: Synthetic oligonucleotide
  Target: AGXT; (-) strand; PAM type: NRG; PAM sequence: CAG
attcatggccacggtccatg

SEQ ID NO: 8103 - DNA, 20 bp, Artificial Sequence
  Description of Artificial Sequence: Synthetic oligonucleotide
  Target: AGXT; (-) strand; PAM type: NRG; PAM sequence: CGG
gtgagctttattcatggcca

SEQ ID NO: 8104 - DNA, 20 bp, Artificial Sequence
  Description of Artificial Sequence: Synthetic oligonucleotide
  Target: AGXT; (-) strand; PAM type: NRG; PAM sequence: TGG
atgtttgtgagctttattca

SEQ ID NO: 8105 - DNA, 20 bp, Artificial Sequence
  Description of Artificial Sequence: Synthetic oligonucleotide
  Target: AGXT; (-) strand; PAM type: NRG; PAM sequence: GAG
gctggccaggttatgtttgt

SEQ ID NO: 8106 - DNA, 20 bp, Artificial Sequence
  Description of Artificial Sequence: Synthetic oligonucleotide
  Target: AGXT; (-) strand; PAM type: NRG; PAM sequence: AGG
gggtgttgctgaagctggcc

SEQ ID NO: 8107 - DNA, 20 bp, Artificial Sequence
  Description of Artificial Sequence: Synthetic oligonucleotide
  Target: AGXT; (-) strand; PAM type: NRG; PAM sequence: CAG
tgggtgttgctgaagctggc

SEQ ID NO: 8108 - DNA, 20 bp, Artificial Sequence
  Description of Artificial Sequence: Synthetic oligonucleotide
  Target: AGXT; (-) strand; PAM type: NRG; PAM sequence: TGG
ggcctgggtgttgctgaagc

SEQ ID NO: 8109 - DNA, 20 bp, Artificial Sequence
  Description of Artificial Sequence: Synthetic oligonucleotide
  Target: AGXT; (-) strand; PAM type: NRG; PAM sequence: AAG
ggatggcctgggtgttgctg

SEQ ID NO: 8110 - DNA, 20 bp, Artificial Sequence
  Description of Artificial Sequence: Synthetic oligonucleotide
  Target: AGXT; (-) strand; PAM type: NRG; PAM sequence: GGG
gccgcaggtggggatggcct

SEQ ID NO: 8111 - DNA, 20 bp, Artificial Sequence
  Description of Artificial Sequence: Synthetic oligonucleotide
  Target: AGXT; (-) strand; PAM type: NRG; PAM sequence: TGG
ggccgcaggtggggatggcc

SEQ ID NO: 8112 - DNA, 20 bp, Artificial Sequence
  Description of Artificial Sequence: Synthetic oligonucleotide
  Target: AGXT; (-) strand; PAM type: NRG; PAM sequence: TGG
gtgctggccgcaggtgggga

SEQ ID NO: 8113 - DNA, 20 bp, Artificial Sequence
  Description of Artificial Sequence: Synthetic oligonucleotide
  Target: AGXT; (-) strand; PAM type: NRG; PAM sequence: GGG
tctcgtgctggccgcaggtg

SEQ ID NO: 8114 - DNA, 20 bp, Artificial Sequence
  Description of Artificial Sequence: Synthetic oligonucleotide
  Target: AGXT; (-) strand; PAM type: NRG; PAM sequence: GGG
atctcgtgctggccgcaggt

SEQ ID NO: 8115 - DNA, 20 bp, Artificial Sequence
  Description of Artificial Sequence: Synthetic oligonucleotide
  Target: AGXT; (-) strand; PAM type: NRG; PAM sequence: TGG
tatctcgtgctggccgcagg

SEQ ID NO: 8116 - DNA, 20 bp, Artificial Sequence
  Description of Artificial Sequence: Synthetic oligonucleotide
  Target: AGXT; (-) strand; PAM type: NRG; PAM sequence: AGG
aagtatctcgtgctggccgc

SEQ ID NO: 8117 - DNA, 20 bp, Artificial Sequence
  Description of Artificial Sequence: Synthetic oligonucleotide
  Target: AGXT; (-) strand; PAM type: NRG; PAM sequence: CAG
aaagtatctcgtgctggccg

SEQ ID NO: 8118 - DNA, 20 bp, Artificial Sequence
  Description of Artificial Sequence: Synthetic oligonucleotide
  Target: AGXT; (-) strand; PAM type: NRG; PAM sequence: TGG
acacagaaagtatctcgtgc

SEQ ID NO: 8119 - DNA, 20 bp, Artificial Sequence
  Description of Artificial Sequence: Synthetic oligonucleotide
  Target: AGXT; (-) strand; PAM type: NRG; PAM sequence: AAG
aaagaaaaaagagacacaga

SEQ ID NO: 8120 - DNA, 20 bp, Artificial Sequence
  Description of Artificial Sequence: Synthetic oligonucleotide
  Target: AGXT; (-) strand; PAM type: NRG; PAM sequence: CAG
ttataaagaaaaaagagaca

SEQ ID NO: 8121 - DNA, 20 bp, Artificial Sequence
  Description of Artificial Sequence: Synthetic oligonucleotide
  Target: AGXT; (-) strand; PAM type: NRG; PAM sequence: GAG
gttttcttataaagaaaaaa

SEQ ID NO: 8122 - DNA, 20 bp, Artificial Sequence
  Description of Artificial Sequence: Synthetic oligonucleotide
  Target: AGXT; (-) strand; PAM type: NRG; PAM sequence: AAG
aggttttcttataaagaaaa

SEQ ID NO: 8123 - DNA, 20 bp, Artificial Sequence
  Description of Artificial Sequence: Synthetic oligonucleotide
  Target: AGXT; (-) strand; PAM type: NRG; PAM sequence: AAG
cacctccaggttttcttata

SEQ ID NO: 8124 - DNA, 20 bp, Artificial Sequence
  Description of Artificial Sequence: Synthetic oligonucleotide
  Target: AGXT; (-) strand; PAM type: NRG; PAM sequence: AGG
tctcaccctcctccacctcc

SEQ ID NO: 8125 - DNA, 20 bp, Artificial Sequence
  Description of Artificial Sequence: Synthetic oligonucleotide
  Target: AGXT; (-) strand; PAM type: NRG; PAM sequence: CAG
ctctcaccctcctccacctc

SEQ ID NO: 8126 - DNA, 20 bp, Artificial Sequence
  Description of Artificial Sequence: Synthetic oligonucleotide
  Target: AGXT; (-) strand; PAM type: NRG; PAM sequence: CAG
tcccagaacagcccaagcag

SEQ ID NO: 8127 - DNA, 20 bp, Artificial Sequence
  Description of Artificial Sequence: Synthetic oligonucleotide
  Target: AGXT; (-) strand; PAM type: NRG; PAM sequence: CAG
gagtcccagaacagcccaag

SEQ ID NO: 8128 - DNA, 20 bp, Artificial Sequence
  Description of Artificial Sequence: Synthetic oligonucleotide
  Target: AGXT; (-) strand; PAM type: NRG; PAM sequence: AAG
acagagtcccagaacagccc

SEQ ID NO: 8129 - DNA, 20 bp, Artificial Sequence
  Description of Artificial Sequence: Synthetic oligonucleotide
  Target: AGXT; (-) strand; PAM type: NRG; PAM sequence: CAG
gaggggacagagtcccagaa

SEQ ID NO: 8130 - DNA, 20 bp, Artificial Sequence
  Description of Artificial Sequence: Synthetic oligonucleotide
  Target: AGXT; (-) strand; PAM type: NRG; PAM sequence: CAG
ggccagaggggacagagtcc

SEQ ID NO: 8131 - DNA, 20 bp, Artificial Sequence
  Description of Artificial Sequence: Synthetic oligonucleotide
  Target: AGXT; (-) strand; PAM type: NRG; PAM sequence: GAG
aatctaggccagaggggaca

SEQ ID NO: 8132 - DNA, 20 bp, Artificial Sequence
  Description of Artificial Sequence: Synthetic oligonucleotide
  Target: AGXT; (-) strand; PAM type: NRG; PAM sequence: CAG
agaatctaggccagagggga

SEQ ID NO: 8133 - DNA, 20 bp, Artificial Sequence
  Description of Artificial Sequence: Synthetic oligonucleotide
  Target: AGXT; (-) strand; PAM type: NRG; PAM sequence: GGG
ggccagaatctaggccagag

SEQ ID NO: 8134 - DNA, 20 bp, Artificial Sequence
  Description of Artificial Sequence: Synthetic oligonucleotide
  Target: AGXT; (-) strand; PAM type: NRG; PAM sequence: GGG
tggccagaatctaggccaga

SEQ ID NO: 8135 - DNA, 20 bp, Artificial Sequence
  Description of Artificial Sequence: Synthetic oligonucleotide
  Target: AGXT; (-) strand; PAM type: NRG; PAM sequence: AGG
ctggccagaatctaggccag

SEQ ID NO: 8136 - DNA, 20 bp, Artificial Sequence
  Description of Artificial Sequence: Synthetic oligonucleotide
  Target: AGXT; (-) strand; PAM type: NRG; PAM sequence: GAG
actggccagaatctaggcca

SEQ ID NO: 8137 - DNA, 20 bp, Artificial Sequence
  Description of Artificial Sequence: Synthetic oligonucleotide
  Target: AGXT; (-) strand; PAM type: NRG; PAM sequence: CAG
ccactggccagaatctaggc

SEQ ID NO: 8138 - DNA, 20 bp, Artificial Sequence
  Description of Artificial Sequence: Synthetic oligonucleotide
  Target: AGXT; (-) strand; PAM type: NRG; PAM sequence: AGG
ccagccactggccagaatct

SEQ ID NO: 8139 - DNA, 20 bp, Artificial Sequence
  Description of Artificial Sequence: Synthetic oligonucleotide
  Target: AGXT; (-) strand; PAM type: NRG; PAM sequence: TAG
cccagccactggccagaatc

SEQ ID NO: 8140 - DNA, 20 bp, Artificial Sequence
  Description of Artificial Sequence: Synthetic oligonucleotide
  Target: AGXT; (-) strand; PAM type: NRG; PAM sequence: CAG
tgctcggcccagccactggc

SEQ ID NO: 8141 - DNA, 20 bp, Artificial Sequence
  Description of Artificial Sequence: Synthetic oligonucleotide
  Target: AGXT; (-) strand; PAM type: NRG; PAM sequence: TGG
cagctgctcggcccagccac

SEQ ID NO: 8142 - DNA, 20 bp, Artificial Sequence
  Description of Artificial Sequence: Synthetic oligonucleotide
  Target: AGXT; (-) strand; PAM type: NRG; PAM sequence: CAG
ctgccaacagctgctcggcc

SEQ ID NO: 8143 - DNA, 20 bp, Artificial Sequence
  Description of Artificial Sequence: Synthetic oligonucleotide
  Target: AGXT; (-) strand; PAM type: NRG; PAM sequence: CGG
tacctctgccaacagctgct

SEQ ID NO: 8144 - DNA, 20 bp, Artificial Sequence
  Description of Artificial Sequence: Synthetic oligonucleotide
  Target: AGXT; (-) strand; PAM type: NRG; PAM sequence: CAG
gctgggcctacctctgccaa

SEQ ID NO: 8145 - DNA, 20 bp, Artificial Sequence
  Description of Artificial Sequence: Synthetic oligonucleotide
  Target: AGXT; (-) strand; PAM type: NRG; PAM sequence: GGG
gaccagggtggcaccaggct

SEQ ID NO: 8146 - DNA, 20 bp, Artificial Sequence
  Description of Artificial Sequence: Synthetic oligonucleotide
  Target: AGXT; (-) strand; PAM type: NRG; PAM sequence: TGG
ggaccagggtggcaccaggc

SEQ ID NO: 8147 - DNA, 20 bp, Artificial Sequence
  Description of Artificial Sequence: Synthetic oligonucleotide
  Target: AGXT; (-) strand; PAM type: NRG; PAM sequence: AGG
ccagggaccagggtggcacc

SEQ ID NO: 8148 - DNA, 20 bp, Artificial Sequence
  Description of Artificial Sequence: Synthetic oligonucleotide
  Target: AGXT; (-) strand; PAM type: NRG; PAM sequence: CAG
cccagggaccagggtggcac

SEQ ID NO: 8149 - DNA, 20 bp, Artificial Sequence
  Description of Artificial Sequence: Synthetic oligonucleotide
  Target: AGXT; (-) strand; PAM type: NRG; PAM sequence: TGG
gtggaccccagggaccaggg

SEQ ID NO: 8150 - DNA, 20 bp, Artificial Sequence
  Description of Artificial Sequence: Synthetic oligonucleotide
  Target: AGXT; (-) strand; PAM type: NRG; PAM sequence: GGG
tgtgtggaccccagggacca

SEQ ID NO: 8151 - DNA, 20 bp, Artificial Sequence
  Description of Artificial Sequence: Synthetic oligonucleotide
  Target: AGXT; (-) strand; PAM type: NRG; PAM sequence: AGG
ctgtgtggaccccagggacc

SEQ ID NO: 8152 - DNA, 20 bp, Artificial Sequence
  Description of Artificial Sequence: Synthetic oligonucleotide
  Target: AGXT; (-) strand; PAM type: NRG; PAM sequence: CAG
cctgtgtggaccccagggac

SEQ ID NO: 8153 - DNA, 20 bp, Artificial Sequence
  Description of Artificial Sequence: Synthetic oligonucleotide
  Target: AGXT; (-) strand; PAM type: NRG; PAM sequence: GGG
gagggcctgtgtggacccca

SEQ ID NO: 8154 - DNA, 20 bp, Artificial Sequence
  Description of Artificial Sequence: Synthetic oligonucleotide
  Target: AGXT; (-) strand; PAM type: NRG; PAM sequence: AGG
tgagggcctgtgtggacccc

SEQ ID NO: 8155 - DNA, 20 bp, Artificial Sequence
  Description of Artificial Sequence: Synthetic oligonucleotide
  Target: AGXT; (-) strand; PAM type: NRG; PAM sequence: CAG
ctgagggcctgtgtggaccc

SEQ ID NO: 8156 - DNA, 20 bp, Artificial Sequence
  Description of Artificial Sequence: Synthetic oligonucleotide
  Target: AGXT; (-) strand; PAM type: NRG; PAM sequence: TGG
cgggtgcctgagggcctgtg

SEQ ID NO: 8157 - DNA, 20 bp, Artificial Sequence
  Description of Artificial Sequence: Synthetic oligonucleotide
  Target: AGXT; (-) strand; PAM type: NRG; PAM sequence: GGG
cagggacagcgggtgcctga

SEQ ID NO: 8158 - DNA, 20 bp, Artificial Sequence
  Description of Artificial Sequence: Synthetic oligonucleotide
  Target: AGXT; (-) strand; PAM type: NRG; PAM sequence: AGG
ccagggacagcgggtgcctg

SEQ ID NO: 8159 - DNA, 20 bp, Artificial Sequence
  Description of Artificial Sequence: Synthetic oligonucleotide
  Target: AGXT; (-) strand; PAM type: NRG; PAM sequence: GAG
cccagggacagcgggtgcct

SEQ ID NO: 8160 - DNA, 20 bp, Artificial Sequence
  Description of Artificial Sequence: Synthetic oligonucleotide
  Target: AGXT; (-) strand; PAM type: NRG; PAM sequence: GGG
ctgtggttcccagggacagc

SEQ ID NO: 8161 - DNA, 20 bp, Artificial Sequence
  Description of Artificial Sequence: Synthetic oligonucleotide
  Target: AGXT; (-) strand; PAM type: NRG; PAM sequence: CGG
tctgtggttcccagggacag

SEQ ID NO: 8162 - DNA, 20 bp, Artificial Sequence
  Description of Artificial Sequence: Synthetic oligonucleotide
  Target: AGXT; (-) strand; PAM type: NRG; PAM sequence: CAG
cagtctgtggttcccaggga

SEQ ID NO: 8163 - DNA, 20 bp, Artificial Sequence
  Description of Artificial Sequence: Synthetic oligonucleotide
  Target: AGXT; (-) strand; PAM type: NRG; PAM sequence: GGG
cgggcagtctgtggttccca

SEQ ID NO: 8164 - DNA, 20 bp, Artificial Sequence
  Description of Artificial Sequence: Synthetic oligonucleotide
  Target: AGXT; (-) strand; PAM type: NRG; PAM sequence: AGG
ccgggcagtctgtggttccc

SEQ ID NO: 8165 - DNA, 20 bp, Artificial Sequence
  Description of Artificial Sequence: Synthetic oligonucleotide
  Target: AGXT; (-) strand; PAM type: NRG; PAM sequence: CAG
gccgggcagtctgtggttcc

SEQ ID NO: 8166 - DNA, 20 bp, Artificial Sequence
  Description of Artificial Sequence: Synthetic oligonucleotide
  Target: AGXT; (-) strand; PAM type: NRG; PAM sequence: TGG
agggtcagccgggcagtctg

SEQ ID NO: 8167 - DNA, 20 bp, Artificial Sequence
  Description of Artificial Sequence: Synthetic oligonucleotide
  Target: AGXT; (-) strand; PAM type: NRG; PAM sequence: CAG
gctgaagagggtcagccggg

SEQ ID NO: 8168 - DNA, 20 bp, Artificial Sequence
  Description of Artificial Sequence: Synthetic oligonucleotide
  Target: AGXT; (-) strand; PAM type: NRG; PAM sequence: GGG
ggtgctgaagagggtcagcc

SEQ ID NO: 8169 - DNA, 20 bp, Artificial Sequence
  Description of Artificial Sequence: Synthetic oligonucleotide
  Target: AGXT; (-) strand; PAM type: NRG; PAM sequence: CGG
tggtgctgaagagggtcagc

SEQ ID NO: 8170 - DNA, 20 bp, Artificial Sequence
  Description of Artificial Sequence: Synthetic oligonucleotide
  Target: AGXT; (-) strand; PAM type: NRG; PAM sequence: CAG
gcagtggtgctgaagagggt

SEQ ID NO: 8171 - DNA, 20 bp, Artificial Sequence
  Description of Artificial Sequence: Synthetic oligonucleotide
  Target: AGXT; (-) strand; PAM type: NRG; PAM sequence: GGG
cccggcagtggtgctgaaga

SEQ ID NO: 8172 - DNA, 20 bp, Artificial Sequence
  Description of Artificial Sequence: Synthetic oligonucleotide
  Target: AGXT; (-) strand; PAM type: NRG; PAM sequence: AGG
gcccggcagtggtgctgaag

SEQ ID NO: 8173 - DNA, 20 bp, Artificial Sequence
  Description of Artificial Sequence: Synthetic oligonucleotide
  Target: AGXT; (-) strand; PAM type: NRG; PAM sequence: GAG
ggcccggcagtggtgctgaa

SEQ ID NO: 8174 - DNA, 20 bp, Artificial Sequence
  Description of Artificial Sequence: Synthetic oligonucleotide
  Target: AGXT; (-) strand; PAM type: NRG; PAM sequence: AAG
agggcccggcagtggtgctg

SEQ ID NO: 8175 - DNA, 20 bp, Artificial Sequence
  Description of Artificial Sequence: Synthetic oligonucleotide
  Target: AGXT; (-) strand; PAM type: NRG; PAM sequence: TGG
ccagctgcagggcccggcag

SEQ ID NO: 8176 - DNA, 20 bp, Artificial Sequence
  Description of Artificial Sequence: Synthetic oligonucleotide
  Target: AGXT; (-) strand; PAM type: NRG; PAM sequence: CAG
gacccagctgcagggcccgg

SEQ ID NO: 8177 - DNA, 20 bp, Artificial Sequence
  Description of Artificial Sequence: Synthetic oligonucleotide
  Target: AGXT; (-) strand; PAM type: NRG; PAM sequence: CGG
tgagacccagctgcagggcc

SEQ ID NO: 8178 - DNA, 20 bp, Artificial Sequence
  Description of Artificial Sequence: Synthetic oligonucleotide
  Target: AGXT; (-) strand; PAM type: NRG; PAM sequence: GGG
cctggtgagacccagctgca

SEQ ID NO: 8179 - DNA, 20 bp, Artificial Sequence
  Description of Artificial Sequence: Synthetic oligonucleotide
  Target: AGXT; (-) strand; PAM type: NRG; PAM sequence: AGG
ccctggtgagacccagctgc

SEQ ID NO: 8180 - DNA, 20 bp, Artificial Sequence
  Description of Artificial Sequence: Synthetic oligonucleotide
  Target: AGXT; (-) strand; PAM type: NRG; PAM sequence: CAG
gccctggtgagacccagctg

SEQ ID NO: 8181 - DNA, 20 bp, Artificial Sequence
  Description of Artificial Sequence: Synthetic oligonucleotide
  Target: AGXT; (-) strand; PAM type: NRG; PAM sequence: CAG
atcacggccctggtgagacc

SEQ ID NO: 8182 - DNA, 20 bp, Artificial Sequence
  Description of Artificial Sequence: Synthetic oligonucleotide
  Target: AGXT; (-) strand; PAM type: NRG; PAM sequence: GAG
gggagcatcacggccctggt

SEQ ID NO: 8183 - DNA, 20 bp, Artificial Sequence
  Description of Artificial Sequence: Synthetic oligonucleotide
  Target: AGXT; (-) strand; PAM type: NRG; PAM sequence: TGG
gtgagggagcatcacggccc

SEQ ID NO: 8184 - DNA, 20 bp, Artificial Sequence
  Description of Artificial Sequence: Synthetic oligonucleotide
  Target: AGXT; (-) strand; PAM type: NRG; PAM sequence: CGG
gggggagtgagggagcatca

SEQ ID NO: 8185 - DNA, 20 bp, Artificial Sequence
  Description of Artificial Sequence: Synthetic oligonucleotide
  Target: AGXT; (-) strand; PAM type: NRG; PAM sequence: GAG
agggagctgggggagtgagg

SEQ ID NO: 8186 - DNA, 20 bp, Artificial Sequence
  Description of Artificial Sequence: Synthetic oligonucleotide
  Target: AGXT; (-) strand; PAM type: NRG; PAM sequence: GGG
agagggagctgggggagtga

SEQ ID NO: 8187 - DNA, 20 bp, Artificial Sequence
  Description of Artificial Sequence: Synthetic oligonucleotide
  Target: AGXT; (-) strand; PAM type: NRG; PAM sequence: AGG
cagagggagctgggggagtg

SEQ ID NO: 8188 - DNA, 20 bp, Artificial Sequence
  Description of Artificial Sequence: Synthetic oligonucleotide
  Target: AGXT; (-) strand; PAM type: NRG; PAM sequence: GAG
gcagagggagctgggggagt

SEQ ID NO: 8189 - DNA, 20 bp, Artificial Sequence
  Description of Artificial Sequence: Synthetic oligonucleotide
  Target: AGXT; (-) strand; PAM type: NRG; PAM sequence: GAG
tggagcagagggagctgggg

SEQ ID NO: 8190 - DNA, 20 bp, Artificial Sequence
  Description of Artificial Sequence: Synthetic oligonucleotide
  Target: AGXT; (-) strand; PAM type: NRG; PAM sequence: GGG
attggagcagagggagctgg

SEQ ID NO: 8191 - DNA, 20 bp, Artificial Sequence
  Description of Artificial Sequence: Synthetic oligonucleotide
  Target: AGXT; (-) strand; PAM type: NRG; PAM sequence: GGG
cattggagcagagggagctg

SEQ ID NO: 8192 - DNA, 20 bp, Artificial Sequence
  Description of Artificial Sequence: Synthetic oligonucleotide
  Target: AGXT; (-) strand; PAM type: NRG; PAM sequence: GGG
acattggagcagagggagct

SEQ ID NO: 8193 - DNA, 20 bp, Artificial Sequence
  Description of Artificial Sequence: Synthetic oligonucleotide
  Target: AGXT; (-) strand; PAM type: NRG; PAM sequence: TGG
aacattggagcagagggagc

SEQ ID NO: 8194 - DNA, 20 bp, Artificial Sequence
  Description of Artificial Sequence: Synthetic oligonucleotide
  Target: AGXT; (-) strand; PAM type: NRG; PAM sequence: GAG
cctgaacattggagcagagg

SEQ ID NO: 8195 - DNA, 20 bp, Artificial Sequence
  Description of Artificial Sequence: Synthetic oligonucleotide
  Target: AGXT; (-) strand; PAM type: NRG; PAM sequence: GGG
gccctgaacattggagcaga

SEQ ID NO: 8196 - DNA, 20 bp, Artificial Sequence
  Description of Artificial Sequence: Synthetic oligonucleotide
  Target: AGXT; (-) strand; PAM type: NRG; PAM sequence: AGG
agccctgaacattggagcag

SEQ ID NO: 8197 - DNA, 20 bp, Artificial Sequence
  Description of Artificial Sequence: Synthetic oligonucleotide
  Target: AGXT; (-) strand; PAM type: NRG; PAM sequence: GAG
cagccctgaacattggagca

SEQ ID NO: 8198 - DNA, 20 bp, Artificial Sequence
  Description of Artificial Sequence: Synthetic oligonucleotide
  Target: AGXT; (-) strand; PAM type: NRG; PAM sequence: CAG
ctcagccctgaacattggag

SEQ ID NO: 8199 - DNA, 20 bp, Artificial Sequence
  Description of Artificial Sequence: Synthetic oligonucleotide
  Target: AGXT; (-) strand; PAM type: NRG; PAM sequence: GAG
tttctcagccctgaacattg

SEQ ID NO: 8200 - DNA, 20 bp, Artificial Sequence
  Description of Artificial Sequence: Synthetic oligonucleotide
  Target: AGXT; (-) strand; PAM type: NRG; PAM sequence: TGG
cctttctcagccctgaacat

SEQ ID NO: 8201 - DNA, 20 bp, Artificial Sequence
  Description of Artificial Sequence: Synthetic oligonucleotide
  Target: AGXT; (-) strand; PAM type: NRG; PAM sequence: CAG
acctgtggctcttcctttct

SEQ ID NO: 8202 - DNA, 20 bp, Artificial Sequence
  Description of Artificial Sequence: Synthetic oligonucleotide
  Target: AGXT; (-) strand; PAM type: NRG; PAM sequence: TGG
tcaggatccatcaggacctg

SEQ ID NO: 8203 - DNA, 20 bp, Artificial Sequence
  Description of Artificial Sequence: Synthetic oligonucleotide
  Target: AGXT; (-) strand; PAM type: NRG; PAM sequence: AGG
cctgcctgtcaggatccatc

SEQ ID NO: 8204 - DNA, 20 bp, Artificial Sequence
  Description of Artificial Sequence: Synthetic oligonucleotide
  Target: AGXT; (-) strand; PAM type: NRG; PAM sequence: CAG
tcctgcctgtcaggatccat

SEQ ID NO: 8205 - DNA, 20 bp, Artificial Sequence
  Description of Artificial Sequence: Synthetic oligonucleotide
  Target: AGXT; (-) strand; PAM type: NRG; PAM sequence: AGG
gttgccttctcctgcctgtc

SEQ ID NO: 8206 - DNA, 20 bp, Artificial Sequence
  Description of Artificial Sequence: Synthetic oligonucleotide
  Target: AGXT; (-) strand; PAM type: NRG; PAM sequence: CAG
agttgccttctcctgcctgt

SEQ ID NO: 8207 - DNA, 20 bp, Artificial Sequence
  Description of Artificial Sequence: Synthetic oligonucleotide
  Target: AGXT; (-) strand; PAM type: NRG; PAM sequence: CAG
cctccaccccaggagttggc

SEQ ID NO: 8208 - DNA, 20 bp, Artificial Sequence
  Description of Artificial Sequence: Synthetic oligonucleotide
  Target: AGXT; (-) strand; PAM type: NRG; PAM sequence: TGG
cccacctccaccccaggagt

SEQ ID NO: 8209 - DNA, 20 bp, Artificial Sequence
  Description of Artificial Sequence: Synthetic oligonucleotide
  Target: AGXT; (-) strand; PAM type: NRG; PAM sequence: GAG
acctcccacctccaccccag

SEQ ID NO: 8210 - DNA, 20 bp, Artificial Sequence
  Description of Artificial Sequence: Synthetic oligonucleotide
  Target: AGXT; (-) strand; PAM type: NRG; PAM sequence: AGG
gcacctcccacctccacccc

SEQ ID NO: 8211 - DNA, 20 bp, Artificial Sequence
  Description of Artificial Sequence: Synthetic oligonucleotide
  Target: AGXT; (-) strand; PAM type: NRG; PAM sequence: CAG
ggcacctcccacctccaccc

SEQ ID NO: 8212 - DNA, 20 bp, Artificial Sequence
  Description of Artificial Sequence: Synthetic oligonucleotide
  Target: AGXT; (-) strand; PAM type: NRG; PAM sequence: GGG
tcaggctggcaaggaaggca

SEQ ID NO: 8213 - DNA, 20 bp, Artificial Sequence
  Description of Artificial Sequence: Synthetic oligonucleotide
  Target: AGXT; (-) strand; PAM type: NRG; PAM sequence: AGG
ctcaggctggcaaggaaggc

SEQ ID NO: 8214 - DNA, 20 bp, Artificial Sequence
  Description of Artificial Sequence: Synthetic oligonucleotide
  Target: AGXT; (-) strand; PAM type: NRG; PAM sequence: CAG
cctcaggctggcaaggaagg

SEQ ID NO: 8215 - DNA, 20 bp, Artificial Sequence
  Description of Artificial Sequence: Synthetic oligonucleotide
  Target: AGXT; (-) strand; PAM type: NRG; PAM sequence: AGG
gagcctcaggctggcaagga

SEQ ID NO: 8216 - DNA, 20 bp, Artificial Sequence
  Description of Artificial Sequence: Synthetic oligonucleotide
  Target: AGXT; (-) strand; PAM type: NRG; PAM sequence: AAG
tgagcctcaggctggcaagg

SEQ ID NO: 8217 - DNA, 20 bp, Artificial Sequence
  Description of Artificial Sequence: Synthetic oligonucleotide
  Target: AGXT; (-) strand; PAM type: NRG; PAM sequence: AGG
ttctgagcctcaggctggca

SEQ ID NO: 8218 - DNA, 20 bp, Artificial Sequence
  Description of Artificial Sequence: Synthetic oligonucleotide
  Target: AGXT; (-) strand; PAM type: NRG; PAM sequence: AAG
tttctgagcctcaggctggc

SEQ ID NO: 8219 - DNA, 20 bp, Artificial Sequence
  Description of Artificial Sequence: Synthetic oligonucleotide
  Target: AGXT; (-) strand; PAM type: NRG; PAM sequence: TGG
ggggtttctgagcctcaggc

SEQ ID NO: 8220 - DNA, 20 bp, Artificial Sequence
  Description of Artificial Sequence: Synthetic oligonucleotide
  Target: AGXT; (-) strand; PAM type: NRG; PAM sequence: AGG
ggatggggtttctgagcctc

SEQ ID NO: 8221 - DNA, 20 bp, Artificial Sequence
  Description of Artificial Sequence: Synthetic oligonucleotide
  Target: AGXT; (-) strand; PAM type: NRG; PAM sequence: CAG
tggatggggtttctgagcct

SEQ ID NO: 8222 - DNA, 20 bp, Artificial Sequence
  Description of Artificial Sequence: Synthetic oligonucleotide
  Target: AGXT; (-) strand; PAM type: NRG; PAM sequence: GAG
ccaggctggatggggtttct

SEQ ID NO: 8223 - DNA, 20 bp, Artificial Sequence
  Description of Artificial Sequence: Synthetic oligonucleotide
  Target: AGXT; (-) strand; PAM type: NRG; PAM sequence: GGG
gcctggccccaggctggatg

SEQ ID NO: 8224 - DNA, 20 bp, Artificial Sequence
  Description of Artificial Sequence: Synthetic oligonucleotide
  Target: AGXT; (-) strand; PAM type: NRG; PAM sequence: GGG
ggcctggccccaggctggat

SEQ ID NO: 8225 - DNA, 20 bp, Artificial Sequence
  Description of Artificial Sequence: Synthetic oligonucleotide
  Target: AGXT; (-) strand; PAM type: NRG; PAM sequence: TGG
gggcctggccccaggctgga

SEQ ID NO: 8226 - DNA, 20 bp, Artificial Sequence
  Description of Artificial Sequence: Synthetic oligonucleotide
  Target: AGXT; (-) strand; PAM type: NRG; PAM sequence: TGG
tggagggcctggccccaggc

SEQ ID NO: 8227 - DNA, 20 bp, Artificial Sequence
  Description of Artificial Sequence: Synthetic oligonucleotide
  Target: AGXT; (-) strand; PAM type: NRG; PAM sequence: AGG
ccactggagggcctggcccc

SEQ ID NO: 8228 - DNA, 20 bp, Artificial Sequence
  Description of Artificial Sequence: Synthetic oligonucleotide
  Target: AGXT; (-) strand; PAM type: NRG; PAM sequence: CAG
gccactggagggcctggccc

SEQ ID NO: 8229 - DNA, 20 bp, Artificial Sequence
  Description of Artificial Sequence: Synthetic oligonucleotide
  Target: AGXT; (-) strand; PAM type: NRG; PAM sequence: TGG
cagggggccactggagggcc

SEQ ID NO: 8230 - DNA, 20 bp, Artificial Sequence
  Description of Artificial Sequence: Synthetic oligonucleotide
  Target: AGXT; (-) strand; PAM type: NRG; PAM sequence: GGG
tgaggcagggggccactgga

SEQ ID NO: 8231 - DNA, 20 bp, Artificial Sequence
  Description of Artificial Sequence: Synthetic oligonucleotide
  Target: AGXT; (-) strand; PAM type: NRG; PAM sequence: AGG
gtgaggcagggggccactgg

SEQ ID NO: 8232 - DNA, 20 bp, Artificial Sequence
  Description of Artificial Sequence: Synthetic oligonucleotide
  Target: AGXT; (-) strand; PAM type: NRG; PAM sequence: GAG
ggtgaggcagggggccactg

SEQ ID NO: 8233 - DNA, 20 bp, Artificial Sequence
  Description of Artificial Sequence: Synthetic oligonucleotide
  Target: AGXT; (-) strand; PAM type: NRG; PAM sequence: TGG
caggtgaggcagggggccac

SEQ ID NO: 8234 - DNA, 20 bp, Artificial Sequence
  Description of Artificial Sequence: Synthetic oligonucleotide
  Target: AGXT; (-) strand; PAM type: NRG; PAM sequence: GGG
agggcagcaggtgaggcagg

SEQ ID NO: 8235 - DNA, 20 bp, Artificial Sequence
  Description of Artificial Sequence: Synthetic oligonucleotide
  Target: AGXT; (-) strand; PAM type: NRG; PAM sequence: GGG
gagggcagcaggtgaggcag

SEQ ID NO: 8236 - DNA, 20 bp, Artificial Sequence
  Description of Artificial Sequence: Synthetic oligonucleotide
  Target: AGXT; (-) strand; PAM type: NRG; PAM sequence: GGG
ggagggcagcaggtgaggca

SEQ ID NO: 8237 - DNA, 20 bp, Artificial Sequence
  Description of Artificial Sequence: Synthetic oligonucleotide
  Target: AGXT; (-) strand; PAM type: NRG; PAM sequence: AGG
tggagggcagcaggtgaggc

SEQ ID NO: 8238 - DNA, 20 bp, Artificial Sequence
  Description of Artificial Sequence: Synthetic oligonucleotide
  Target: AGXT; (-) strand; PAM type: NRG; PAM sequence: CAG
atggagggcagcaggtgagg

SEQ ID NO: 8239 - DNA, 20 bp, Artificial Sequence
  Description of Artificial Sequence: Synthetic oligonucleotide
  Target: AGXT; (-) strand; PAM type: NRG; PAM sequence: AGG
agaatggagggcagcaggtg

SEQ ID NO: 8240 - DNA, 20 bp, Artificial Sequence
  Description of Artificial Sequence: Synthetic oligonucleotide
  Target: AGXT; (-) strand; PAM type: NRG; PAM sequence: GAG
cagaatggagggcagcaggt

SEQ ID NO: 8241 - DNA, 20 bp, Artificial Sequence
  Description of Artificial Sequence: Synthetic oligonucleotide
  Target: AGXT; (-) strand; PAM type: NRG; PAM sequence: AGG
gggacagaatggagggcagc

SEQ ID NO: 8242 - DNA, 20 bp, Artificial Sequence
  Description of Artificial Sequence: Synthetic oligonucleotide
  Target: AGXT; (-) strand; PAM type: NRG; PAM sequence: CAG
ggggacagaatggagggcag

SEQ ID NO: 8243 - DNA, 20 bp, Artificial Sequence
  Description of Artificial Sequence: Synthetic oligonucleotide
  Target: AGXT; (-) strand; PAM type: NRG; PAM sequence: CAG
gtgggggacagaatggaggg

SEQ ID NO: 8244 - DNA, 20 bp, Artificial Sequence
  Description of Artificial Sequence: Synthetic oligonucleotide
  Target: AGXT; (-) strand; PAM type: NRG; PAM sequence: GGG
gaggtgggggacagaatgga

SEQ ID NO: 8245 - DNA, 20 bp, Artificial Sequence
  Description of Artificial Sequence: Synthetic oligonucleotide
  Target: AGXT; (-) strand; PAM type: NRG; PAM sequence: AGG
agaggtgggggacagaatgg

SEQ ID NO: 8246 - DNA, 20 bp, Artificial Sequence
  Description of Artificial Sequence: Synthetic oligonucleotide
  Target: AGXT; (-) strand; PAM type: NRG; PAM sequence: GAG
gagaggtgggggacagaatg

SEQ ID NO: 8247 - DNA, 20 bp, Artificial Sequence
  Description of Artificial Sequence: Synthetic oligonucleotide
  Target: AGXT; (-) strand; PAM type: NRG; PAM sequence: TGG
tggagaggtgggggacagaa

SEQ ID NO: 8248 - DNA, 20 bp, Artificial Sequence
  Description of Artificial Sequence: Synthetic oligonucleotide
  Target: AGXT; (-) strand; PAM type: NRG; PAM sequence: CAG
gtacctggagaggtggggga

SEQ ID NO: 8249 - DNA, 20 bp, Artificial Sequence
  Description of Artificial Sequence: Synthetic oligonucleotide
  Target: AGXT; (-) strand; PAM type: NRG; PAM sequence: GGG
acttgtacctggagaggtgg

SEQ ID NO: 8250 - DNA, 20 bp, Artificial Sequence
  Description of Artificial Sequence: Synthetic oligonucleotide
  Target: AGXT; (-) strand; PAM type: NRG; PAM sequence: GGG
cacttgtacctggagaggtg

SEQ ID NO: 8251 - DNA, 20 bp, Artificial Sequence
  Description of Artificial Sequence: Synthetic oligonucleotide
  Target: AGXT; (-) strand; PAM type: NRG; PAM sequence: GGG
gcacttgtacctggagaggt

SEQ ID NO: 8252 - DNA, 20 bp, Artificial Sequence
  Description of Artificial Sequence: Synthetic oligonucleotide
  Target: AGXT; (-) strand; PAM type: NRG; PAM sequence: TGG
ggcacttgtacctggagagg

SEQ ID NO: 8253 - DNA, 20 bp, Artificial Sequence
  Description of Artificial Sequence: Synthetic oligonucleotide
  Target: AGXT; (-) strand; PAM type: NRG; PAM sequence: AGG
gcaggcacttgtacctggag

SEQ ID NO: 8254 - DNA, 20 bp, Artificial Sequence
  Description of Artificial Sequence: Synthetic oligonucleotide
  Target: AGXT; (-) strand; PAM type: NRG; PAM sequence: GAG
agcaggcacttgtacctgga

SEQ ID NO: 8255 - DNA, 20 bp, Artificial Sequence
  Description of Artificial Sequence: Synthetic oligonucleotide
  Target: AGXT; (-) strand; PAM type: NRG; PAM sequence: GAG
ggagcaggcacttgtacctg

SEQ ID NO: 8256 - DNA, 20 bp, Artificial Sequence
  Description of Artificial Sequence: Synthetic oligonucleotide
  Target: AGXT; (-) strand; PAM type: NRG; PAM sequence: TGG
caggagcaggcacttgtacc

SEQ ID NO: 8257 - DNA, 20 bp, Artificial Sequence
  Description of Artificial Sequence: Synthetic oligonucleotide
  Target: AGXT; (-) strand; PAM type: NRG; PAM sequence: AGG
ccaccgaatccaccaggagc

SEQ ID NO: 8258 - DNA, 20 bp, Artificial Sequence
  Description of Artificial Sequence: Synthetic oligonucleotide
  Target: AGXT; (-) strand; PAM type: NRG; PAM sequence: CAG
gccaccgaatccaccaggag

SEQ ID NO: 8259 - DNA, 20 bp, Artificial Sequence
  Description of Artificial Sequence: Synthetic oligonucleotide
  Target: AGXT; (-) strand; PAM type: NRG; PAM sequence: GAG
gatgccaccgaatccaccag

SEQ ID NO: 8260 - DNA, 20 bp, Artificial Sequence
  Description of Artificial Sequence: Synthetic oligonucleotide
  Target: AGXT; (-) strand; PAM type: NRG; PAM sequence: AGG
gggatgccaccgaatccacc

SEQ ID NO: 8261 - DNA, 20 bp, Artificial Sequence
  Description of Artificial Sequence: Synthetic oligonucleotide
  Target: AGXT; (-) strand; PAM type: NRG; PAM sequence: CAG
agggatgccaccgaatccac

SEQ ID NO: 8262 - DNA, 20 bp, Artificial Sequence
  Description of Artificial Sequence: Synthetic oligonucleotide
  Target: AGXT; (-) strand; PAM type: NRG; PAM sequence: GGG
gtaaaggggggtcccgccca

SEQ ID NO: 8263 - DNA, 20 bp, Artificial Sequence
  Description of Artificial Sequence: Synthetic oligonucleotide
  Target: AGXT; (-) strand; PAM type: NRG; PAM sequence: AGG
tgtaaaggggggtcccgccc

SEQ ID NO: 8264 - DNA, 20 bp, Artificial Sequence
  Description of Artificial Sequence: Synthetic oligonucleotide
  Target: AGXT; (-) strand; PAM type: NRG; PAM sequence: CAG
atgtaaaggggggtcccgcc

SEQ ID NO: 8265 - DNA, 20 bp, Artificial Sequence
  Description of Artificial Sequence: Synthetic oligonucleotide
  Target: AGXT; (-) strand; PAM type: NRG; PAM sequence: GGG
ttgccggtccatgtaaaggg

SEQ ID NO: 8266 - DNA, 20 bp, Artificial Sequence
  Description of Artificial Sequence: Synthetic oligonucleotide
  Target: AGXT; (-) strand; PAM type: NRG; PAM sequence: GGG
cttgccggtccatgtaaagg

SEQ ID NO: 8267 - DNA, 20 bp, Artificial Sequence
  Description of Artificial Sequence: Synthetic oligonucleotide
  Target: AGXT; (-) strand; PAM type: NRG; PAM sequence: GGG
ccttgccggtccatgtaaag

SEQ ID NO: 8268 - DNA, 20 bp, Artificial Sequence
  Description of Artificial Sequence: Synthetic oligonucleotide
  Target: AGXT; (-) strand; PAM type: NRG; PAM sequence: GGG
accttgccggtccatgtaaa

SEQ ID NO: 8269 - DNA, 20 bp, Artificial Sequence
  Description of Artificial Sequence: Synthetic oligonucleotide
  Target: AGXT; (-) strand; PAM type: NRG; PAM sequence: AGG
taccttgccggtccatgtaa

SEQ ID NO: 8270 - DNA, 20 bp, Artificial Sequence
  Description of Artificial Sequence: Synthetic oligonucleotide
  Target: AGXT; (-) strand; PAM type: NRG; PAM sequence: AAG
ttaccttgccggtccatgta

SEQ ID NO: 8271 - DNA, 20 bp, Artificial Sequence
  Description of Artificial Sequence: Synthetic oligonucleotide
  Target: AGXT; (-) strand; PAM type: NRG; PAM sequence: CGG
agagcccacccttaccttgc

SEQ ID NO: 8272 - DNA, 20 bp, Artificial Sequence
  Description of Artificial Sequence: Synthetic oligonucleotide
  Target: AGXT; (-) strand; PAM type: NRG; PAM sequence: GAG
tgggctgggtagggctctca

SEQ ID NO: 8273 - DNA, 20 bp, Artificial Sequence
  Description of Artificial Sequence: Synthetic oligonucleotide
  Target: AGXT; (-) strand; PAM type: NRG; PAM sequence: CAG
cttgggctgggtagggctct

SEQ ID NO: 8274 - DNA, 20 bp, Artificial Sequence
  Description of Artificial Sequence: Synthetic oligonucleotide
  Target: AGXT; (-) strand; PAM type: NRG; PAM sequence: GGG
aaggctgcttgggctgggta

SEQ ID NO: 8275 - DNA, 20 bp, Artificial Sequence
  Description of Artificial Sequence: Synthetic oligonucleotide
  Target: AGXT; (-) strand; PAM type: NRG; PAM sequence: AGG
caaggctgcttgggctgggt

SEQ ID NO: 8276 - DNA, 20 bp, Artificial Sequence
  Description of Artificial Sequence: Synthetic oligonucleotide
  Target: AGXT; (-) strand; PAM type: NRG; PAM sequence: TAG
ccaaggctgcttgggctggg

SEQ ID NO: 8277 - DNA, 20 bp, Artificial Sequence
  Description of Artificial Sequence: Synthetic oligonucleotide
  Target: AGXT; (-) strand; PAM type: NRG; PAM sequence: GGG
gccccaaggctgcttgggct

SEQ ID NO: 8278 - DNA, 20 bp, Artificial Sequence
  Description of Artificial Sequence: Synthetic oligonucleotide
  Target: AGXT; (-) strand; PAM type: NRG; PAM sequence: TGG
agccccaaggctgcttgggc

SEQ ID NO: 8279 - DNA, 20 bp, Artificial Sequence
  Description of Artificial Sequence: Synthetic oligonucleotide
  Target: AGXT; (-) strand; PAM type: NRG; PAM sequence: GGG
gcggagccccaaggctgctt

SEQ ID NO: 8280 - DNA, 20 bp, Artificial Sequence
  Description of Artificial Sequence: Synthetic oligonucleotide
  Target: AGXT; (-) strand; PAM type: NRG; PAM sequence: TGG
cgcggagccccaaggctgct

SEQ ID NO: 8281 - DNA, 20 bp, Artificial Sequence
  Description of Artificial Sequence: Synthetic oligonucleotide
  Target: AGXT; (-) strand; PAM type: NRG; PAM sequence: AGG
ttcctgcacgcggagcccca

SEQ ID NO: 8282 - DNA, 20 bp, Artificial Sequence
  Description of Artificial Sequence: Synthetic oligonucleotide
  Target: AGXT; (-) strand; PAM type: NRG; PAM sequence: AAG
cttcctgcacgcggagcccc

SEQ ID NO: 8283 - DNA, 20 bp, Artificial Sequence
  Description of Artificial Sequence: Synthetic oligonucleotide
  Target: AGXT; (-) strand; PAM type: NRG; PAM sequence: GAG
agcagggcttcctgcacgcg

SEQ ID NO: 8284 - DNA, 20 bp, Artificial Sequence
  Description of Artificial Sequence: Synthetic oligonucleotide
  Target: AGXT; (-) strand; PAM type: NRG; PAM sequence: CGG
ccagcagggcttcctgcacg

SEQ ID NO: 8285 - DNA, 20 bp, Artificial Sequence
  Description of Artificial Sequence: Synthetic oligonucleotide
  Target: AGXT; (-) strand; PAM type: NRG; PAM sequence: GGG
ctggacgcacgcttccagca

SEQ ID NO: 8286 - DNA, 20 bp, Artificial Sequence
  Description of Artificial Sequence: Synthetic oligonucleotide
  Target: AGXT; (-) strand; PAM type: NRG; PAM sequence: AGG
gctggacgcacgcttccagc

SEQ ID NO: 8287 - DNA, 20 bp, Artificial Sequence
  Description of Artificial Sequence: Synthetic oligonucleotide
  Target: AGXT; (-) strand; PAM type: NRG; PAM sequence: CAG
tgctggacgcacgcttccag

SEQ ID NO: 8288 - DNA, 20 bp, Artificial Sequence
  Description of Artificial Sequence: Synthetic oligonucleotide
  Target: AGXT; (-) strand; PAM type: NRG; PAM sequence: CAG
ggctgctggacgcacgcttc

SEQ ID NO: 8289 - DNA, 20 bp, Artificial Sequence
  Description of Artificial Sequence: Synthetic oligonucleotide
  Target: AGXT; (-) strand; PAM type: NRG; PAM sequence: TGG
gaatccgcagcatcggctgc

SEQ ID NO: 8290 - DNA, 20 bp, Artificial Sequence
  Description of Artificial Sequence: Synthetic oligonucleotide
  Target: AGXT; (-) strand; PAM type: NRG; PAM sequence: CGG
tggggccgaatccgcagcat

SEQ ID NO: 8291 - DNA, 20 bp, Artificial Sequence
  Description of Artificial Sequence: Synthetic oligonucleotide
  Target: AGXT; (-) strand; PAM type: NRG; PAM sequence: CAG
tggagatggggccgaatccg

SEQ ID NO: 8292 - DNA, 20 bp, Artificial Sequence
  Description of Artificial Sequence: Synthetic oligonucleotide
  Target: AGXT; (-) strand; PAM type: NRG; PAM sequence: GGG
ccctgggcctggtggagatg

SEQ ID NO: 8293 - DNA, 20 bp, Artificial Sequence
  Description of Artificial Sequence: Synthetic oligonucleotide
  Target: AGXT; (-) strand; PAM type: NRG; PAM sequence: GGG
tccctgggcctggtggagat

SEQ ID NO: 8294 - DNA, 20 bp, Artificial Sequence
  Description of Artificial Sequence: Synthetic oligonucleotide
  Target: AGXT; (-) strand; PAM type: NRG; PAM sequence: TGG
ttccctgggcctggtggaga

SEQ ID NO: 8295 - DNA, 20 bp, Artificial Sequence
  Description of Artificial Sequence: Synthetic oligonucleotide
  Target: AGXT; (-) strand; PAM type: NRG; PAM sequence: GAG
gtgtttccctgggcctggtg

SEQ ID NO: 8296 - DNA, 20 bp, Artificial Sequence
  Description of Artificial Sequence: Synthetic oligonucleotide
  Target: AGXT; (-) strand; PAM type: NRG; PAM sequence: TGG
gagtgtttccctgggcctgg

SEQ ID NO: 8297 - DNA, 20 bp, Artificial Sequence
  Description of Artificial Sequence: Synthetic oligonucleotide
  Target: AGXT; (-) strand; PAM type: NRG; PAM sequence: TGG
agtgagtgtttccctgggcc

SEQ ID NO: 8298 - DNA, 20 bp, Artificial Sequence
  Description of Artificial Sequence: Synthetic oligonucleotide
  Target: AGXT; (-) strand; PAM type: NRG; PAM sequence: GGG
taaggagtgagtgtttccct

SEQ ID NO: 8299 - DNA, 20 bp, Artificial Sequence
  Description of Artificial Sequence: Synthetic oligonucleotide
  Target: AGXT; (-) strand; PAM type: NRG; PAM sequence: TGG
gtaaggagtgagtgtttccc

SEQ ID NO: 8300 - DNA, 20 bp, Artificial Sequence
  Description of Artificial Sequence: Synthetic oligonucleotide
  Target: AGXT; (-) strand; PAM type: NRG; PAM sequence: GAG
ctcttgccgcagtaaggagt

SEQ ID NO: 8301 - DNA, 20 bp, Artificial Sequence
  Description of Artificial Sequence: Synthetic oligonucleotide
  Target: AGXT; (-) strand; PAM type: NRG; PAM sequence: GAG
gccgctcttgccgcagtaag

SEQ ID NO: 8302 - DNA, 20 bp, Artificial Sequence
  Description of Artificial Sequence: Synthetic oligonucleotide
  Target: AGXT; (-) strand; PAM type: NRG; PAM sequence: AGG
gagccgctcttgccgcagta

SEQ ID NO: 8303 - DNA, 20 bp, Artificial Sequence
  Description of Artificial Sequence: Synthetic oligonucleotide
  Target: AGXT; (-) strand; PAM type: NRG; PAM sequence: AAG
ggagccgctcttgccgcagt

SEQ ID NO: 8304 - DNA, 20 bp, Artificial Sequence
  Description of Artificial Sequence: Synthetic oligonucleotide
  Target: AGXT; (-) strand; PAM type: NRG; PAM sequence: CAG
tcatggagccgctcttgccg

SEQ ID NO: 8305 - DNA, 20 bp, Artificial Sequence
  Description of Artificial Sequence: Synthetic oligonucleotide
  Target: AGXT; (-) strand; PAM type: NRG; PAM sequence: GAG
ggggtgctgggtagttcatg

SEQ ID NO: 8306 - DNA, 20 bp, Artificial Sequence
  Description of Artificial Sequence: Synthetic oligonucleotide
  Target: AGXT; (-) strand; PAM type: NRG; PAM sequence: TGG
ctggggtgctgggtagttca

SEQ ID NO: 8307 - DNA, 20 bp, Artificial Sequence
  Description of Artificial Sequence: Synthetic oligonucleotide
  Target: AGXT; (-) strand; PAM type: NRG; PAM sequence: TAG
ggaaacactggggtgctggg

SEQ ID NO: 8308 - DNA, 20 bp, Artificial Sequence
  Description of Artificial Sequence: Synthetic oligonucleotide
  Target: AGXT; (-) strand; PAM type: NRG; PAM sequence: GGG
agtggaaacactggggtgct

SEQ ID NO: 8309 - DNA, 20 bp, Artificial Sequence
  Description of Artificial Sequence: Synthetic oligonucleotide
  Target: AGXT; (-) strand; PAM type: NRG; PAM sequence: TGG
cagtggaaacactggggtgc

SEQ ID NO: 8310 - DNA, 20 bp, Artificial Sequence
  Description of Artificial Sequence: Synthetic oligonucleotide
  Target: AGXT; (-) strand; PAM type: NRG; PAM sequence: GGG
aaagctcagtggaaacactg

SEQ ID NO: 8311 - DNA, 20 bp, Artificial Sequence
  Description of Artificial Sequence: Synthetic oligonucleotide
  Target: AGXT; (-) strand; PAM type: NRG; PAM sequence: GGG
gaaagctcagtggaaacact

SEQ ID NO: 8312 - DNA, 20 bp, Artificial Sequence
  Description of Artificial Sequence: Synthetic oligonucleotide
  Target: AGXT; (-) strand; PAM type: NRG; PAM sequence: TGG
tgaaagctcagtggaaacac

SEQ ID NO: 8313 - DNA, 20 bp, Artificial Sequence
  Description of Artificial Sequence: Synthetic oligonucleotide
  Target: AGXT; (-) strand; PAM type: NRG; PAM sequence: TGG
gcctggatctgaaagctcag

SEQ ID NO: 8314 - DNA, 20 bp, Artificial Sequence
  Description of Artificial Sequence: Synthetic oligonucleotide
  Target: AGXT; (-) strand; PAM type: NRG; PAM sequence: CAG
cacgcctggatctgaaagct

SEQ ID NO: 8315 - DNA, 20 bp, Artificial Sequence
  Description of Artificial Sequence: Synthetic oligonucleotide
  Target: AGXT; (-) strand; PAM type: NRG; PAM sequence: AAG
gtccccacgcctggatctga

SEQ ID NO: 8316 - DNA, 20 bp, Artificial Sequence
  Description of Artificial Sequence: Synthetic oligonucleotide
  Target: AGXT; (-) strand; PAM type: NRG; PAM sequence: TGG
ctcctgccagtccccacgcc

SEQ ID NO: 8317 - DNA, 20 bp, Artificial Sequence
  Description of Artificial Sequence: Synthetic oligonucleotide
  Target: AGXT; (-) strand; PAM type: NRG; PAM sequence: CAG
ccagaagctgtccctcctgc

SEQ ID NO: 8318 - DNA, 20 bp, Artificial Sequence
  Description of Artificial Sequence: Synthetic oligonucleotide
  Target: AGXT; (-) strand; PAM type: NRG; PAM sequence: AAG
tctcaaatgtcccccaccag

SEQ ID NO: 8319 - DNA, 20 bp, Artificial Sequence
  Description of Artificial Sequence: Synthetic oligonucleotide
  Target: AGXT; (-) strand; PAM type: NRG; PAM sequence: CAG
gcatctcaaatgtcccccac

SEQ ID NO: 8320 - DNA, 20 bp, Artificial Sequence
  Description of Artificial Sequence: Synthetic oligonucleotide
  Target: AGXT; (-) strand; PAM type: NRG; PAM sequence: GGG
ctgcttctgctacagctctg

SEQ ID NO: 8321 - DNA, 20 bp, Artificial Sequence
  Description of Artificial Sequence: Synthetic oligonucleotide
  Target: AGXT; (-) strand; PAM type: NRG; PAM sequence: GGG
actgcttctgctacagctct

SEQ ID NO: 8322 - DNA, 20 bp, Artificial Sequence
  Description of Artificial Sequence: Synthetic oligonucleotide
  Target: AGXT; (-) strand; PAM type: NRG; PAM sequence: TGG
cactgcttctgctacagctc

SEQ ID NO: 8323 - DNA, 20 bp, Artificial Sequence
  Description of Artificial Sequence: Synthetic oligonucleotide
  Target: AGXT; (-) strand; PAM type: NRG; PAM sequence: CAG
tcttcccactgcttctgcta

SEQ ID NO: 8324 - DNA, 20 bp, Artificial Sequence
  Description of Artificial Sequence: Synthetic oligonucleotide
  Target: AGXT; (-) strand; PAM type: NRG; PAM sequence: TGG
cgcctgattgactggagccc

SEQ ID NO: 8325 - DNA, 20 bp, Artificial Sequence
  Description of Artificial Sequence: Synthetic oligonucleotide
  Target: AGXT; (-) strand; PAM type: NRG; PAM sequence: GAG
gcccaacgcctgattgactg

SEQ ID NO: 8326 - DNA, 20 bp, Artificial Sequence
  Description of Artificial Sequence: Synthetic oligonucleotide
  Target: AGXT; (-) strand; PAM type: NRG; PAM sequence: TGG
gtgcccaacgcctgattgac

SEQ ID NO: 8327 - DNA, 20 bp, Artificial Sequence
  Description of Artificial Sequence: Synthetic oligonucleotide
  Target: AGXT; (-) strand; PAM type: NRG; PAM sequence: GGG
ctctggggggttgggcagag

SEQ ID NO: 8328 - DNA, 20 bp, Artificial Sequence
  Description of Artificial Sequence: Synthetic oligonucleotide
  Target: AGXT; (-) strand; PAM type: NRG; PAM sequence: GGG
cctctggggggttgggcaga

SEQ ID NO: 8329 - DNA, 20 bp, Artificial Sequence
  Description of Artificial Sequence: Synthetic oligonucleotide
  Target: AGXT; (-) strand; PAM type: NRG; PAM sequence: AGG
gcctctggggggttgggcag

SEQ ID NO: 8330 - DNA, 20 bp, Artificial Sequence
  Description of Artificial Sequence: Synthetic oligonucleotide
  Target: AGXT; (-) strand; PAM type: NRG; PAM sequence: GAG
agcctctggggggttgggca

SEQ ID NO: 8331 - DNA, 20 bp, Artificial Sequence
  Description of Artificial Sequence: Synthetic oligonucleotide
  Target: AGXT; (-) strand; PAM type: NRG; PAM sequence: CAG
tgagcctctggggggttggg

SEQ ID NO: 8332 - DNA, 20 bp, Artificial Sequence
  Description of Artificial Sequence: Synthetic oligonucleotide
  Target: AGXT; (-) strand; PAM type: NRG; PAM sequence: GGG
aactgagcctctggggggtt

SEQ ID NO: 8333 - DNA, 20 bp, Artificial Sequence
  Description of Artificial Sequence: Synthetic oligonucleotide
  Target: AGXT; (-) strand; PAM type: NRG; PAM sequence: TGG
aaactgagcctctggggggt

SEQ ID NO: 8334 - DNA, 20 bp, Artificial Sequence
  Description of Artificial Sequence: Synthetic oligonucleotide
  Target: AGXT; (-) strand; PAM type: NRG; PAM sequence: GGG
tgtgaaactgagcctctggg

SEQ ID NO: 8335 - DNA, 20 bp, Artificial Sequence
  Description of Artificial Sequence: Synthetic oligonucleotide
  Target: AGXT; (-) strand; PAM type: NRG; PAM sequence: GGG
atgtgaaactgagcctctgg

SEQ ID NO: 8336 - DNA, 20 bp, Artificial Sequence
  Description of Artificial Sequence: Synthetic oligonucleotide
  Target: AGXT; (-) strand; PAM type: NRG; PAM sequence: GGG
gatgtgaaactgagcctctg

SEQ ID NO: 8337 - DNA, 20 bp, Artificial Sequence
  Description of Artificial Sequence: Synthetic oligonucleotide
  Target: AGXT; (-) strand; PAM type: NRG; PAM sequence: GGG
agatgtgaaactgagcctct

SEQ ID NO: 8338 - DNA, 20 bp, Artificial Sequence
  Description of Artificial Sequence: Synthetic oligonucleotide
  Target: AGXT; (-) strand; PAM type: NRG; PAM sequence: TGG
cagatgtgaaactgagcctc

SEQ ID NO: 8339 - DNA, 20 bp, Artificial Sequence
  Description of Artificial Sequence: Synthetic oligonucleotide
  Target: AGXT; (-) strand; PAM type: NRG; PAM sequence: GAG
cgcagggcagatgtgaaact

SEQ ID NO: 8340 - DNA, 20 bp, Artificial Sequence
  Description of Artificial Sequence: Synthetic oligonucleotide
  Target: AGXT; (-) strand; PAM type: NRG; PAM sequence: CAG
cagcctggcagggcgcaggg

SEQ ID NO: 8341 - DNA, 20 bp, Artificial Sequence
  Description of Artificial Sequence: Synthetic oligonucleotide
  Target: AGXT; (-) strand; PAM type: NRG; PAM sequence: GGG
gggcagcctggcagggcgca

SEQ ID NO: 8342 - DNA, 20 bp, Artificial Sequence
  Description of Artificial Sequence: Synthetic oligonucleotide
  Target: AGXT; (-) strand; PAM type: NRG; PAM sequence: AGG
tgggcagcctggcagggcgc

SEQ ID NO: 8343 - DNA, 20 bp, Artificial Sequence
  Description of Artificial Sequence: Synthetic oligonucleotide
  Target: AGXT; (-) strand; PAM type: NRG; PAM sequence: CAG
atgggcagcctggcagggcg

SEQ ID NO: 8344 - DNA, 20 bp, Artificial Sequence
  Description of Artificial Sequence: Synthetic oligonucleotide
  Target: AGXT; (-) strand; PAM type: NRG; PAM sequence: GGG
ctgctatgggcagcctggca

SEQ ID NO: 8345 - DNA, 20 bp, Artificial Sequence
  Description of Artificial Sequence: Synthetic oligonucleotide
  Target: AGXT; (-) strand; PAM type: NRG; PAM sequence: AGG
actgctatgggcagcctggc

SEQ ID NO: 8346 - DNA, 20 bp, Artificial Sequence
  Description of Artificial Sequence: Synthetic oligonucleotide
  Target: AGXT; (-) strand; PAM type: NRG; PAM sequence: CAG
cactgctatgggcagcctgg

SEQ ID NO: 8347 - DNA, 20 bp, Artificial Sequence
  Description of Artificial Sequence: Synthetic oligonucleotide
  Target: AGXT; (-) strand; PAM type: NRG; PAM sequence: TGG
gctcactgctatgggcagcc

SEQ ID NO: 8348 - DNA, 20 bp, Artificial Sequence
  Description of Artificial Sequence: Synthetic oligonucleotide
  Target: AGXT; (-) strand; PAM type: NRG; PAM sequence: CAG
gtggtgctcactgctatggg

SEQ ID NO: 8349 - DNA, 20 bp, Artificial Sequence
  Description of Artificial Sequence: Synthetic oligonucleotide
  Target: AGXT; (-) strand; PAM type: NRG; PAM sequence: GGG
acagtggtgctcactgctat

SEQ ID NO: 8350 - DNA, 20 bp, Artificial Sequence
  Description of Artificial Sequence: Synthetic oligonucleotide
  Target: AGXT; (-) strand; PAM type: NRG; PAM sequence: TGG
gacagtggtgctcactgcta

SEQ ID NO: 8351 - DNA, 20 bp, Artificial Sequence
  Description of Artificial Sequence: Synthetic oligonucleotide
  Target: AGXT; (-) strand; PAM type: NRG; PAM sequence: TGG
ctgcgaggtgaccctgacag

SEQ ID NO: 8352 - DNA, 20 bp, Artificial Sequence
  Description of Artificial Sequence: Synthetic oligonucleotide
  Target: AGXT; (-) strand; PAM type: NRG; PAM sequence: CAG
tccctgcgaggtgaccctga

SEQ ID NO: 8353 - DNA, 20 bp, Artificial Sequence
  Description of Artificial Sequence: Synthetic oligonucleotide
  Target: AGXT; (-) strand; PAM type: NRG; PAM sequence: AGG
cctggttgaggttccctgcg

SEQ ID NO: 8354 - DNA, 20 bp, Artificial Sequence
  Description of Artificial Sequence: Synthetic oligonucleotide
  Target: AGXT; (-) strand; PAM type: NRG; PAM sequence: GAG
gcctggttgaggttccctgc

SEQ ID NO: 8355 - DNA, 20 bp, Artificial Sequence
  Description of Artificial Sequence: Synthetic oligonucleotide
  Target: AGXT; (-) strand; PAM type: NRG; PAM sequence: AGG
cccctcggccggcctggttg

SEQ ID NO: 8356 - DNA, 20 bp, Artificial Sequence
  Description of Artificial Sequence: Synthetic oligonucleotide
  Target: AGXT; (-) strand; PAM type: NRG; PAM sequence: GAG
gcccctcggccggcctggtt

SEQ ID NO: 8357 - DNA, 20 bp, Artificial Sequence
  Description of Artificial Sequence: Synthetic oligonucleotide
  Target: AGXT; (-) strand; PAM type: NRG; PAM sequence: TGG
ccttggcccctcggccggcc

SEQ ID NO: 8358 - DNA, 20 bp, Artificial Sequence
  Description of Artificial Sequence: Synthetic oligonucleotide
  Target: AGXT; (-) strand; PAM type: NRG; PAM sequence: CGG
aggctccttggcccctcggc

SEQ ID NO: 8359 - DNA, 20 bp, Artificial Sequence
  Description of Artificial Sequence: Synthetic oligonucleotide
  Target: AGXT; (-) strand; PAM type: NRG; PAM sequence: CGG
caggaggctccttggcccct

SEQ ID NO: 8360 - DNA, 20 bp, Artificial Sequence
  Description of Artificial Sequence: Synthetic oligonucleotide
  Target: AGXT; (-) strand; PAM type: NRG; PAM sequence: TGG
gatgggcacaggaggctcct

SEQ ID NO: 8361 - DNA, 20 bp, Artificial Sequence
  Description of Artificial Sequence: Synthetic oligonucleotide
  Target: AGXT; (-) strand; PAM type: NRG; PAM sequence: AGG
cgtaagcggatgggcacagg

SEQ ID NO: 8362 - DNA, 20 bp, Artificial Sequence
  Description of Artificial Sequence: Synthetic oligonucleotide
  Target: AGXT; (-) strand; PAM type: NRG; PAM sequence: GAG
ccgtaagcggatgggcacag

SEQ ID NO: 8363 - DNA, 20 bp, Artificial Sequence
  Description of Artificial Sequence: Synthetic oligonucleotide
  Target: AGXT; (-) strand; PAM type: NRG; PAM sequence: AGG
tcccgtaagcggatgggcac

SEQ ID NO: 8364 - DNA, 20 bp, Artificial Sequence
  Description of Artificial Sequence: Synthetic oligonucleotide
  Target: AGXT; (-) strand; PAM type: NRG; PAM sequence: CAG
ctcccgtaagcggatgggca

SEQ ID NO: 8365 - DNA, 20 bp, Artificial Sequence
  Description of Artificial Sequence: Synthetic oligonucleotide
  Target: AGXT; (-) strand; PAM type: NRG; PAM sequence: GGG
gctctctcccgtaagcggat

SEQ ID NO: 8366 - DNA, 20 bp, Artificial Sequence
  Description of Artificial Sequence: Synthetic oligonucleotide
  Target: AGXT; (-) strand; PAM type: NRG; PAM sequence: TGG
ggctctctcccgtaagcgga

SEQ ID NO: 8367 - DNA, 20 bp, Artificial Sequence
  Description of Artificial Sequence: Synthetic oligonucleotide
  Target: AGXT; (-) strand; PAM type: NRG; PAM sequence: CGG
tgcaggctctctcccgtaag

SEQ ID NO: 8368 - DNA, 20 bp, Artificial Sequence
  Description of Artificial Sequence: Synthetic oligonucleotide
  Target: AGXT; (-) strand; PAM type: NRG; PAM sequence: AAG
atgtgcaggctctctcccgt

SEQ ID NO: 8369 - DNA, 20 bp, Artificial Sequence
  Description of Artificial Sequence: Synthetic oligonucleotide
  Target: AGXT; (-) strand; PAM type: NRG; PAM sequence: AGG
ccgcagtggatgcaatgtgc

SEQ ID NO: 8370 - DNA, 20 bp, Artificial Sequence
  Description of Artificial Sequence: Synthetic oligonucleotide
  Target: AGXT; (-) strand; PAM type: NRG; PAM sequence: CAG
accgcagtggatgcaatgtg

SEQ ID NO: 8371 - DNA, 20 bp, Artificial Sequence
  Description of Artificial Sequence: Synthetic oligonucleotide
  Target: AGXT; (-) strand; PAM type: NRG; PAM sequence: TGG
tgggtgggcaggcaccgcag

SEQ ID NO: 8372 - DNA, 20 bp, Artificial Sequence
  Description of Artificial Sequence: Synthetic oligonucleotide
  Target: AGXT; (-) strand; PAM type: NRG; PAM sequence: CAG
gagtgggtgggcaggcaccg

SEQ ID NO: 8373 - DNA, 20 bp, Artificial Sequence
  Description of Artificial Sequence: Synthetic oligonucleotide
  Target: AGXT; (-) strand; PAM type: NRG; PAM sequence: AGG
ctcccatggagtgggtgggc

SEQ ID NO: 8374 - DNA, 20 bp, Artificial Sequence
  Description of Artificial Sequence: Synthetic oligonucleotide
  Target: AGXT; (-) strand; PAM type: NRG; PAM sequence: CAG
gctcccatggagtgggtggg

SEQ ID NO: 8375 - DNA, 20 bp, Artificial Sequence
  Description of Artificial Sequence: Synthetic oligonucleotide
  Target: AGXT; (-) strand; PAM type: NRG; PAM sequence: GGG
caggctcccatggagtgggt

SEQ ID NO: 8376 - DNA, 20 bp, Artificial Sequence
  Description of Artificial Sequence: Synthetic oligonucleotide
  Target: AGXT; (-) strand; PAM type: NRG; PAM sequence: TGG
acaggctcccatggagtggg

SEQ ID NO: 8377 - DNA, 20 bp, Artificial Sequence
  Description of Artificial Sequence: Synthetic oligonucleotide
  Target: AGXT; (-) strand; PAM type: NRG; PAM sequence: GGG
cagacaggctcccatggagt

SEQ ID NO: 8378 - DNA, 20 bp, Artificial Sequence
  Description of Artificial Sequence: Synthetic oligonucleotide
  Target: AGXT; (-) strand; PAM type: NRG; PAM sequence: TGG
acagacaggctcccatggag

SEQ ID NO: 8379 - DNA, 20 bp, Artificial Sequence
  Description of Artificial Sequence: Synthetic oligonucleotide
  Target: AGXT; (-) strand; PAM type: NRG; PAM sequence: GAG
gaaacagacaggctcccatg

SEQ ID NO: 8380 - DNA, 20 bp, Artificial Sequence
  Description of Artificial Sequence: Synthetic oligonucleotide
  Target: AGXT; (-) strand; PAM type: NRG; PAM sequence: TGG
cagaaacagacaggctccca

SEQ ID NO: 8381 - DNA, 20 bp, Artificial Sequence
  Description of Artificial Sequence: Synthetic oligonucleotide
  Target: AGXT; (-) strand; PAM type: NRG; PAM sequence: AGG
ggggctctgcagaaacagac

SEQ ID NO: 8382 - DNA, 20 bp, Artificial Sequence
  Description of Artificial Sequence: Synthetic oligonucleotide
  Target: AGXT; (-) strand; PAM type: NRG; PAM sequence: CAG
aggggctctgcagaaacaga

SEQ ID NO: 8383 - DNA, 20 bp, Artificial Sequence
  Description of Artificial Sequence: Synthetic oligonucleotide
  Target: AGXT; (-) strand; PAM type: NRG; PAM sequence: CAG
caggaggggctctgcagaaa

SEQ ID NO: 8384 - DNA, 20 bp, Artificial Sequence
  Description of Artificial Sequence: Synthetic oligonucleotide
  Target: AGXT; (-) strand; PAM type: NRG; PAM sequence: CAG
ccaaatcaggaggggctctg

SEQ ID NO: 8385 - DNA, 20 bp, Artificial Sequence
  Description of Artificial Sequence: Synthetic oligonucleotide
  Target: AGXT; (-) strand; PAM type: NRG; PAM sequence: GGG
gagaactcccaaatcaggag

SEQ ID NO: 8386 - DNA, 20 bp, Artificial Sequence
  Description of Artificial Sequence: Synthetic oligonucleotide
  Target: AGXT; (-) strand; PAM type: NRG; PAM sequence: GGG
tgagaactcccaaatcagga

SEQ ID NO: 8387 - DNA, 20 bp, Artificial Sequence
  Description of Artificial Sequence: Synthetic oligonucleotide
  Target: AGXT; (-) strand; PAM type: NRG; PAM sequence: AGG
ctgagaactcccaaatcagg

SEQ ID NO: 8388 - DNA, 20 bp, Artificial Sequence
  Description of Artificial Sequence: Synthetic oligonucleotide
  Target: AGXT; (-) strand; PAM type: NRG; PAM sequence: GAG
cctgagaactcccaaatcag

SEQ ID NO: 8389 - DNA, 20 bp, Artificial Sequence
  Description of Artificial Sequence: Synthetic oligonucleotide
  Target: AGXT; (-) strand; PAM type: NRG; PAM sequence: AGG
tgcctgagaactcccaaatc

SEQ ID NO: 8390 - DNA, 20 bp, Artificial Sequence
  Description of Artificial Sequence: Synthetic oligonucleotide
  Target: AGXT; (-) strand; PAM type: NRG; PAM sequence: CAG
ctgcctgagaactcccaaat

SEQ ID NO: 8391 - DNA, 20 bp, Artificial Sequence
  Description of Artificial Sequence: Synthetic oligonucleotide
  Target: AGXT; (-) strand; PAM type: NRG; PAM sequence: GAG
aaatccctcccttcctgcct

SEQ ID NO: 8392 - DNA, 20 bp, Artificial Sequence
  Description of Artificial Sequence: Synthetic oligonucleotide
  Target: AGXT; (-) strand; PAM type: NRG; PAM sequence: CAG
tagtagtttgaggatcagcc

SEQ ID NO: 8393 - DNA, 20 bp, Artificial Sequence
  Description of Artificial Sequence: Synthetic oligonucleotide
  Target: AGXT; (-) strand; PAM type: NRG; PAM sequence: CAG
ttcagtagtagtttgaggat

SEQ ID NO: 8394 - DNA, 20 bp, Artificial Sequence
  Description of Artificial Sequence: Synthetic oligonucleotide
  Target: AGXT; (-) strand; PAM type: NRG; PAM sequence: AGG
ctgctttcagtagtagtttg

SEQ ID NO: 8395 - DNA, 20 bp, Artificial Sequence
  Description of Artificial Sequence: Synthetic oligonucleotide
  Target: AGXT; (-) strand; PAM type: NRG; PAM sequence: GAG
cctgctttcagtagtagttt

SEQ ID NO: 8396 - DNA, 20 bp, Artificial Sequence
  Description of Artificial Sequence: Synthetic oligonucleotide
  Target: AGXT; (-) strand; PAM type: NRG; PAM sequence: TAG
caggtccctgctttcagtag

SEQ ID NO: 8397 - DNA, 20 bp, Artificial Sequence
  Description of Artificial Sequence: Synthetic oligonucleotide
  Target: AGXT; (-) strand; PAM type: NRG; PAM sequence: TAG
ccccaggtccctgctttcag

SEQ ID NO: 8398 - DNA, 20 bp, Artificial Sequence
  Description of Artificial Sequence: Synthetic oligonucleotide
  Target: AGXT; (-) strand; PAM type: NRG; PAM sequence: CAG
cctccccaggtccctgcttt

SEQ ID NO: 8399 - DNA, 20 bp, Artificial Sequence
  Description of Artificial Sequence: Synthetic oligonucleotide
  Target: AGXT; (-) strand; PAM type: NRG; PAM sequence: AGG
gtgtccctggggccctcccc

SEQ ID NO: 8400 - DNA, 20 bp, Artificial Sequence
  Description of Artificial Sequence: Synthetic oligonucleotide
  Target: AGXT; (-) strand; PAM type: NRG; PAM sequence: CAG
cgtgtccctggggccctccc

SEQ ID NO: 8401 - DNA, 20 bp, Artificial Sequence
  Description of Artificial Sequence: Synthetic oligonucleotide
  Target: AGXT; (-) strand; PAM type: NRG; PAM sequence: GGG
ccccaggcaccgtgtccctg

SEQ ID NO: 8402 - DNA, 20 bp, Artificial Sequence
  Description of Artificial Sequence: Synthetic oligonucleotide
  Target: AGXT; (-) strand; PAM type: NRG; PAM sequence: GGG
accccaggcaccgtgtccct

SEQ ID NO: 8403 - DNA, 20 bp, Artificial Sequence
  Description of Artificial Sequence: Synthetic oligonucleotide
  Target: AGXT; (-) strand; PAM type: NRG; PAM sequence: TGG
caccccaggcaccgtgtccc

SEQ ID NO: 8404 - DNA, 20 bp, Artificial Sequence
  Description of Artificial Sequence: Synthetic oligonucleotide
  Target: AGXT; (-) strand; PAM type: NRG; PAM sequence: AGG
agggacagccctgccacccc

SEQ ID NO: 8405 - DNA, 20 bp, Artificial Sequence
  Description of Artificial Sequence: Synthetic oligonucleotide
  Target: AGXT; (-) strand; PAM type: NRG; PAM sequence: CAG
cagggacagccctgccaccc

SEQ ID NO: 8406 - DNA, 20 bp, Artificial Sequence
  Description of Artificial Sequence: Synthetic oligonucleotide
  Target: AGXT; (-) strand; PAM type: NRG; PAM sequence: CAG
gctgtgctggtccccaggga

SEQ ID NO: 8407 - DNA, 20 bp, Artificial Sequence
  Description of Artificial Sequence: Synthetic oligonucleotide
  Target: AGXT; (-) strand; PAM type: NRG; PAM sequence: GGG
ctctgctgtgctggtcccca

SEQ ID NO: 8408 - DNA, 20 bp, Artificial Sequence
  Description of Artificial Sequence: Synthetic oligonucleotide
  Target: AGXT; (-) strand; PAM type: NRG; PAM sequence: AGG
cctctgctgtgctggtcccc

SEQ ID NO: 8409 - DNA, 20 bp, Artificial Sequence
  Description of Artificial Sequence: Synthetic oligonucleotide
  Target: AGXT; (-) strand; PAM type: NRG; PAM sequence: CAG
ccctctgctgtgctggtccc

SEQ ID NO: 8410 - DNA, 20 bp, Artificial Sequence
  Description of Artificial Sequence: Synthetic oligonucleotide
  Target: AGXT; (-) strand; PAM type: NRG; PAM sequence: TGG
agcttctccctctgctgtgc

SEQ ID NO: 8411 - DNA, 20 bp, Artificial Sequence
  Description of Artificial Sequence: Synthetic oligonucleotide
  Target: AGXT; (-) strand; PAM type: NRG; PAM sequence: CAG
caggcctgagcgttttagcg

SEQ ID NO: 8412 - DNA, 20 bp, Artificial Sequence
  Description of Artificial Sequence: Synthetic oligonucleotide
  Target: AGXT; (-) strand; PAM type: NRG; PAM sequence: TAG
gacctcaggcctgagcgttt

SEQ ID NO: 8413 - DNA, 20 bp, Artificial Sequence
  Description of Artificial Sequence: Synthetic oligonucleotide
  Target: AGXT; (-) strand; PAM type: NRG; PAM sequence: GAG
gcagccatgacctcaggcct

SEQ ID NO: 8414 - DNA, 20 bp, Artificial Sequence
  Description of Artificial Sequence: Synthetic oligonucleotide
  Target: AGXT; (-) strand; PAM type: NRG; PAM sequence: AGG
tgcgtggcagccatgacctc

SEQ ID NO: 8415 - DNA, 20 bp, Artificial Sequence
  Description of Artificial Sequence: Synthetic oligonucleotide
  Target: AGXT; (-) strand; PAM type: NRG; PAM sequence: CAG
ctgcgtggcagccatgacct

SEQ ID NO: 8416 - DNA, 20 bp, Artificial Sequence
  Description of Artificial Sequence: Synthetic oligonucleotide
  Target: AGXT; (-) strand; PAM type: NRG; PAM sequence: CAG
atctgggcactgctgcgtgg

SEQ ID NO: 8417 - DNA, 20 bp, Artificial Sequence
  Description of Artificial Sequence: Synthetic oligonucleotide
  Target: AGXT; (-) strand; PAM type: NRG; PAM sequence: TGG
caaatctgggcactgctgcg

SEQ ID NO: 8418 - DNA, 20 bp, Artificial Sequence
  Description of Artificial Sequence: Synthetic oligonucleotide
  Target: AGXT; (-) strand; PAM type: NRG; PAM sequence: GGG
ggagtcctgggttcaaatct

SEQ ID NO: 8419 - DNA, 20 bp, Artificial Sequence
  Description of Artificial Sequence: Synthetic oligonucleotide
  Target: AGXT; (-) strand; PAM type: NRG; PAM sequence: TGG
gggagtcctgggttcaaatc

SEQ ID NO: 8420 - DNA, 20 bp, Artificial Sequence
  Description of Artificial Sequence: Synthetic oligonucleotide
  Target: AGXT; (-) strand; PAM type: NRG; PAM sequence: GGG
gagatgtggaagggagtcct

SEQ ID NO: 8421 - DNA, 20 bp, Artificial Sequence
  Description of Artificial Sequence: Synthetic oligonucleotide
  Target: AGXT; (-) strand; PAM type: NRG; PAM sequence: TGG
ggagatgtggaagggagtcc

SEQ ID NO: 8422 - DNA, 20 bp, Artificial Sequence
  Description of Artificial Sequence: Synthetic oligonucleotide
  Target: AGXT; (-) strand; PAM type: NRG; PAM sequence: GAG
agcaggggagatgtggaagg

SEQ ID NO: 8423 - DNA, 20 bp, Artificial Sequence
  Description of Artificial Sequence: Synthetic oligonucleotide
  Target: AGXT; (-) strand; PAM type: NRG; PAM sequence: GGG
atagcaggggagatgtggaa

SEQ ID NO: 8424 - DNA, 20 bp, Artificial Sequence
  Description of Artificial Sequence: Synthetic oligonucleotide
  Target: AGXT; (-) strand; PAM type: NRG; PAM sequence: AGG
gatagcaggggagatgtgga

SEQ ID NO: 8425 - DNA, 20 bp, Artificial Sequence
  Description of Artificial Sequence: Synthetic oligonucleotide
  Target: AGXT; (-) strand; PAM type: NRG; PAM sequence: AAG
cgatagcaggggagatgtgg

SEQ ID NO: 8426 - DNA, 20 bp, Artificial Sequence
  Description of Artificial Sequence: Synthetic oligonucleotide
  Target: AGXT; (-) strand; PAM type: NRG; PAM sequence: TGG
acacgatagcaggggagatg

SEQ ID NO: 8427 - DNA, 20 bp, Artificial Sequence
  Description of Artificial Sequence: Synthetic oligonucleotide
  Target: AGXT; (-) strand; PAM type: NRG; PAM sequence: GAG
atccgtacacgatagcaggg

SEQ ID NO: 8428 - DNA, 20 bp, Artificial Sequence
  Description of Artificial Sequence: Synthetic oligonucleotide
  Target: AGXT; (-) strand; PAM type: NRG; PAM sequence: GGG
gaatccgtacacgatagcag

SEQ ID NO: 8429 - DNA, 20 bp, Artificial Sequence
  Description of Artificial Sequence: Synthetic oligonucleotide
  Target: AGXT; (-) strand; PAM type: NRG; PAM sequence: GGG
cgaatccgtacacgatagca

SEQ ID NO: 8430 - DNA, 20 bp, Artificial Sequence
  Description of Artificial Sequence: Synthetic oligonucleotide
  Target: AGXT; (-) strand; PAM type: NRG; PAM sequence: AGG
acgaatccgtacacgatagc

SEQ ID NO: 8431 - DNA, 20 bp, Artificial Sequence
  Description of Artificial Sequence: Synthetic oligonucleotide
  Target: AGXT; (-) strand; PAM type: NRG; PAM sequence: CAG
cacgaatccgtacacgatag

SEQ ID NO: 8432 - DNA, 20 bp, Artificial Sequence
  Description of Artificial Sequence: Synthetic oligonucleotide
  Target: AGXT; (-) strand; PAM type: NRG; PAM sequence: TAG
taccacgaatccgtacacga

SEQ ID NO: 8433 - DNA, 20 bp, Artificial Sequence
  Description of Artificial Sequence: Synthetic oligonucleotide
  Target: AGXT; (-) strand; PAM type: NRG; PAM sequence: AGG
tgcctagctaatgggctggt

SEQ ID NO: 8434 - DNA, 20 bp, Artificial Sequence
  Description of Artificial Sequence: Synthetic oligonucleotide
  Target: AGXT; (-) strand; PAM type: NRG; PAM sequence: TAG
ctgcctagctaatgggctgg

SEQ ID NO: 8435 - DNA, 20 bp, Artificial Sequence
  Description of Artificial Sequence: Synthetic oligonucleotide
  Target: AGXT; (-) strand; PAM type: NRG; PAM sequence: TGG
tgcctgcctagctaatgggc

SEQ ID NO: 8436 - DNA, 20 bp, Artificial Sequence
  Description of Artificial Sequence: Synthetic oligonucleotide
  Target: AGXT; (-) strand; PAM type: NRG; PAM sequence: GGG
gggatgcctgcctagctaat

SEQ ID NO: 8437 - DNA, 20 bp, Artificial Sequence
  Description of Artificial Sequence: Synthetic oligonucleotide
  Target: AGXT; (-) strand; PAM type: NRG; PAM sequence: TGG
cgggatgcctgcctagctaa

SEQ ID NO: 8438 - DNA, 20 bp, Artificial Sequence
  Description of Artificial Sequence: Synthetic oligonucleotide
  Target: AGXT; (-) strand; PAM type: NRG; PAM sequence: TAG
agtccagcgggatgcctgcc

SEQ ID NO: 8439 - DNA, 20 bp, Artificial Sequence
  Description of Artificial Sequence: Synthetic oligonucleotide
  Target: AGXT; (-) strand; PAM type: NRG; PAM sequence: GGG
tcagggcaggccagtccagc

SEQ ID NO: 8440 - DNA, 20 bp, Artificial Sequence
  Description of Artificial Sequence: Synthetic oligonucleotide
  Target: AGXT; (-) strand; PAM type: NRG; PAM sequence: CGG
ctcagggcaggccagtccag

SEQ ID NO: 8441 - DNA, 20 bp, Artificial Sequence
  Description of Artificial Sequence: Synthetic oligonucleotide
  Target: AGXT; (-) strand; PAM type: NRG; PAM sequence: CAG
cacctcagggcaggccagtc

SEQ ID NO: 8442 - DNA, 20 bp, Artificial Sequence
  Description of Artificial Sequence: Synthetic oligonucleotide
  Target: AGXT; (-) strand; PAM type: NRG; PAM sequence: CAG
agtcccacctcagggcaggc

SEQ ID NO: 8443 - DNA, 20 bp, Artificial Sequence
  Description of Artificial Sequence: Synthetic oligonucleotide
  Target: AGXT; (-) strand; PAM type: NRG; PAM sequence: AGG
ggtgagtcccacctcagggc

SEQ ID NO: 8444 - DNA, 20 bp, Artificial Sequence
  Description of Artificial Sequence: Synthetic oligonucleotide
  Target: AGXT; (-) strand; PAM type: NRG; PAM sequence: CAG
gggtgagtcccacctcaggg

SEQ ID NO: 8445 - DNA, 20 bp, Artificial Sequence
  Description of Artificial Sequence: Synthetic oligonucleotide
  Target: AGXT; (-) strand; PAM type: NRG; PAM sequence: GGG
gacgggtgagtcccacctca

SEQ ID NO: 8446 - DNA, 20 bp, Artificial Sequence
  Description of Artificial Sequence: Synthetic oligonucleotide
  Target: AGXT; (-) strand; PAM type: NRG; PAM sequence: AGG
ggacgggtgagtcccacctc

SEQ ID NO: 8447 - DNA, 20 bp, Artificial Sequence
  Description of Artificial Sequence: Synthetic oligonucleotide
  Target: AGXT; (-) strand; PAM type: NRG; PAM sequence: CAG
gggacgggtgagtcccacct

SEQ ID NO: 8448 - DNA, 20 bp, Artificial Sequence
  Description of Artificial Sequence: Synthetic oligonucleotide
  Target: AGXT; (-) strand; PAM type: NRG; PAM sequence: GAG
gtggtttgctcgggacgggt

SEQ ID NO: 8449 - DNA, 20 bp, Artificial Sequence
  Description of Artificial Sequence: Synthetic oligonucleotide
  Target: AGXT; (-) strand; PAM type: NRG; PAM sequence: GGG
atgggtggtttgctcgggac

SEQ ID NO: 8450 - DNA, 20 bp, Artificial Sequence
  Description of Artificial Sequence: Synthetic oligonucleotide
  Target: AGXT; (-) strand; PAM type: NRG; PAM sequence: CGG
gatgggtggtttgctcggga

SEQ ID NO: 8451 - DNA, 20 bp, Artificial Sequence
  Description of Artificial Sequence: Synthetic oligonucleotide
  Target: AGXT; (-) strand; PAM type: NRG; PAM sequence: GGG
tgtagatgggtggtttgctc

SEQ ID NO: 8452 - DNA, 20 bp, Artificial Sequence
  Description of Artificial Sequence: Synthetic oligonucleotide
  Target: AGXT; (-) strand; PAM type: NRG; PAM sequence: CGG
ctgtagatgggtggtttgct

SEQ ID NO: 8453 - DNA, 20 bp, Artificial Sequence
  Description of Artificial Sequence: Synthetic oligonucleotide
  Target: AGXT; (-) strand; PAM type: NRG; PAM sequence: TGG
tgtcgatgcctgtagatggg

SEQ ID NO: 8454 - DNA, 20 bp, Artificial Sequence
  Description of Artificial Sequence: Synthetic oligonucleotide
  Target: AGXT; (-) strand; PAM type: NRG; PAM sequence: GGG
ggatgtcgatgcctgtagat

SEQ ID NO: 8455 - DNA, 20 bp, Artificial Sequence
  Description of Artificial Sequence: Synthetic oligonucleotide
  Target: AGXT; (-) strand; PAM type: NRG; PAM sequence: TGG
aggatgtcgatgcctgtaga

SEQ ID NO: 8456 - DNA, 20 bp, Artificial Sequence
  Description of Artificial Sequence: Synthetic oligonucleotide
  Target: AGXT; (-) strand; PAM type: NRG; PAM sequence: TAG
gtacaggatgtcgatgcctg

SEQ ID NO: 8457 - DNA, 20 bp, Artificial Sequence
  Description of Artificial Sequence: Synthetic oligonucleotide
  Target: AGXT; (-) strand; PAM type: NRG; PAM sequence: AGG
ccttctgggagcccgagtac

SEQ ID NO: 8458 - DNA, 20 bp, Artificial Sequence
  Description of Artificial Sequence: Synthetic oligonucleotide
  Target: AGXT; (-) strand; PAM type: NRG; PAM sequence: CAG
gccttctgggagcccgagta

SEQ ID NO: 8459 - DNA, 20 bp, Artificial Sequence
  Description of Artificial Sequence: Synthetic oligonucleotide
  Target: AGXT; (-) strand; PAM type: NRG; PAM sequence: GAG
tcagggccttctgggagccc

SEQ ID NO: 8460 - DNA, 20 bp, Artificial Sequence
  Description of Artificial Sequence: Synthetic oligonucleotide
  Target: AGXT; (-) strand; PAM type: NRG; PAM sequence: GAG
gggcgttcagggccttctgg

SEQ ID NO: 8461 - DNA, 20 bp, Artificial Sequence
  Description of Artificial Sequence: Synthetic oligonucleotide
  Target: AGXT; (-) strand; PAM type: NRG; PAM sequence: GGG
aggggcgttcagggccttct

SEQ ID NO: 8462 - DNA, 20 bp, Artificial Sequence
  Description of Artificial Sequence: Synthetic oligonucleotide
  Target: AGXT; (-) strand; PAM type: NRG; PAM sequence: TGG
gaggggcgttcagggccttc

SEQ ID NO: 8463 - DNA, 20 bp, Artificial Sequence
  Description of Artificial Sequence: Synthetic oligonucleotide
  Target: AGXT; (-) strand; PAM type: NRG; PAM sequence: GGG
ggtccctggaggggcgttca

SEQ ID NO: 8464 - DNA, 20 bp, Artificial Sequence
  Description of Artificial Sequence: Synthetic oligonucleotide
  Target: AGXT; (-) strand; PAM type: NRG; PAM sequence: AGG
aggtccctggaggggcgttc

SEQ ID NO: 8465 - DNA, 20 bp, Artificial Sequence
  Description of Artificial Sequence: Synthetic oligonucleotide
  Target: AGXT; (-) strand; PAM type: NRG; PAM sequence: CAG
gaggtccctggaggggcgtt

SEQ ID NO: 8466 - DNA, 20 bp, Artificial Sequence
  Description of Artificial Sequence: Synthetic oligonucleotide
  Target: AGXT; (-) strand; PAM type: NRG; PAM sequence: GGG
gatgagcgaggtccctggag

SEQ ID NO: 8467 - DNA, 20 bp, Artificial Sequence
  Description of Artificial Sequence: Synthetic oligonucleotide
  Target: AGXT; (-) strand; PAM type: NRG; PAM sequence: GGG
agatgagcgaggtccctgga

SEQ ID NO: 8468 - DNA, 20 bp, Artificial Sequence
  Description of Artificial Sequence: Synthetic oligonucleotide
  Target: AGXT; (-) strand; PAM type: NRG; PAM sequence: AGG
gagatgagcgaggtccctgg

SEQ ID NO: 8469 - DNA, 20 bp, Artificial Sequence
  Description of Artificial Sequence: Synthetic oligonucleotide
  Target: AGXT; (-) strand; PAM type: NRG; PAM sequence: GAG
ggagatgagcgaggtccctg

SEQ ID NO: 8470 - DNA, 20 bp, Artificial Sequence
  Description of Artificial Sequence: Synthetic oligonucleotide
  Target: AGXT; (-) strand; PAM type: NRG; PAM sequence: TGG
aaggagatgagcgaggtccc

SEQ ID NO: 8471 - DNA, 20 bp, Artificial Sequence
  Description of Artificial Sequence: Synthetic oligonucleotide
  Target: AGXT; (-) strand; PAM type: NRG; PAM sequence: AGG
gtcactgaaggagatgagcg

SEQ ID NO: 8472 - DNA, 20 bp, Artificial Sequence
  Description of Artificial Sequence: Synthetic oligonucleotide
  Target: AGXT; (-) strand; PAM type: NRG; PAM sequence: GAG
tgtcactgaaggagatgagc

SEQ ID NO: 8473 - DNA, 20 bp, Artificial Sequence
  Description of Artificial Sequence: Synthetic oligonucleotide
  Target: AGXT; (-) strand; PAM type: NRG; PAM sequence: GAG
gccttgtcactgaaggagat

SEQ ID NO: 8474 - DNA, 20 bp, Artificial Sequence
  Description of Artificial Sequence: Synthetic oligonucleotide
  Target: AGXT; (-) strand; PAM type: NRG; PAM sequence: GAG
acttggccttgtcactgaag

SEQ ID NO: 8475 - DNA, 20 bp, Artificial Sequence
  Description of Artificial Sequence: Synthetic oligonucleotide
  Target: AGXT; (-) strand; PAM type: NRG; PAM sequence: AGG
tcacttggccttgtcactga

SEQ ID NO: 8476 - DNA, 20 bp, Artificial Sequence
  Description of Artificial Sequence: Synthetic oligonucleotide
  Target: AGXT; (-) strand; PAM type: NRG; PAM sequence: AAG
ctcacttggccttgtcactg

SEQ ID NO: 8477 - DNA, 20 bp, Artificial Sequence
  Description of Artificial Sequence: Synthetic oligonucleotide
  Target: AGXT; (-) strand; PAM type: NRG; PAM sequence: TGG
gggtctgtgggtcactcact

SEQ ID NO: 8478 - DNA, 20 bp, Artificial Sequence
  Description of Artificial Sequence: Synthetic oligonucleotide
  Target: AGXT; (-) strand; PAM type: NRG; PAM sequence: GGG
gcacagaggtgagggtctgt

SEQ ID NO: 8479 - DNA, 20 bp, Artificial Sequence
  Description of Artificial Sequence: Synthetic oligonucleotide
  Target: AGXT; (-) strand; PAM type: NRG; PAM sequence: TGG
tgcacagaggtgagggtctg

SEQ ID NO: 8480 - DNA, 20 bp, Artificial Sequence
  Description of Artificial Sequence: Synthetic oligonucleotide
  Target: AGXT; (-) strand; PAM type: NRG; PAM sequence: GGG
ccagccctgcacagaggtga

SEQ ID NO: 8481 - DNA, 20 bp, Artificial Sequence
  Description of Artificial Sequence: Synthetic oligonucleotide
  Target: AGXT; (-) strand; PAM type: NRG; PAM sequence: AGG
cccagccctgcacagaggtg

SEQ ID NO: 8482 - DNA, 20 bp, Artificial Sequence
  Description of Artificial Sequence: Synthetic oligonucleotide
  Target: AGXT; (-) strand; PAM type: NRG; PAM sequence: GAG
gcccagccctgcacagaggt

SEQ ID NO: 8483 - DNA, 20 bp, Artificial Sequence
  Description of Artificial Sequence: Synthetic oligonucleotide
  Target: AGXT; (-) strand; PAM type: NRG; PAM sequence: AGG
gcaagcccagccctgcacag

SEQ ID NO: 8484 - DNA, 20 bp, Artificial Sequence
  Description of Artificial Sequence: Synthetic oligonucleotide
  Target: AGXT; (-) strand; PAM type: NRG; PAM sequence: GAG
tgcaagcccagccctgcaca

SEQ ID NO: 8485 - DNA, 20 bp, Artificial Sequence
  Description of Artificial Sequence: Synthetic oligonucleotide
  Target: AGXT; (-) strand; PAM type: NRG; PAM sequence: CAG
cctgcaagcccagccctgca

SEQ ID NO: 8486 - DNA, 20 bp, Artificial Sequence
  Description of Artificial Sequence: Synthetic oligonucleotide
  Target: AGXT; (-) strand; PAM type: NRG; PAM sequence: CAG
acctgagctccctgcaagcc

SEQ ID NO: 8487 - DNA, 20 bp, Artificial Sequence
  Description of Artificial Sequence: Synthetic oligonucleotide
  Target: AGXT; (-) strand; PAM type: NRG; PAM sequence: AAG
gggccacctgagctccctgc

SEQ ID NO: 8488 - DNA, 20 bp, Artificial Sequence
  Description of Artificial Sequence: Synthetic oligonucleotide
  Target: AGXT; (-) strand; PAM type: NRG; PAM sequence: GAG
cctcccgcctcgggccacct

SEQ ID NO: 8489 - DNA, 20 bp, Artificial Sequence
  Description of Artificial Sequence: Synthetic oligonucleotide
  Target: AGXT; (-) strand; PAM type: NRG; PAM sequence: GGG
gctcccgcccctcccgcctc

SEQ ID NO: 8490 - DNA, 20 bp, Artificial Sequence
  Description of Artificial Sequence: Synthetic oligonucleotide
  Target: AGXT; (-) strand; PAM type: NRG; PAM sequence: CGG
ggctcccgcccctcccgcct

SEQ ID NO: 8491 - DNA, 20 bp, Artificial Sequence
  Description of Artificial Sequence: Synthetic oligonucleotide
  Target: AGXT; (-) strand; PAM type: NRG; PAM sequence: TGG
catggggagcccttcctgcc

SEQ ID NO: 8492 - DNA, 20 bp, Artificial Sequence
  Description of Artificial Sequence: Synthetic oligonucleotide
  Target: AGXT; (-) strand; PAM type: NRG; PAM sequence: GAG
aggtgctggaggagcatggg

SEQ ID NO: 8493 - DNA, 20 bp, Artificial Sequence
  Description of Artificial Sequence: Synthetic oligonucleotide
  Target: AGXT; (-) strand; PAM type: NRG; PAM sequence: GGG
ccaggtgctggaggagcatg

SEQ ID NO: 8494 - DNA, 20 bp, Artificial Sequence
  Description of Artificial Sequence: Synthetic oligonucleotide
  Target: AGXT; (-) strand; PAM type: NRG; PAM sequence: GGG
gccaggtgctggaggagcat

SEQ ID NO: 8495 - DNA, 20 bp, Artificial Sequence
  Description of Artificial Sequence: Synthetic oligonucleotide
  Target: AGXT; (-) strand; PAM type: NRG; PAM sequence: TGG
cgccaggtgctggaggagca

SEQ ID NO: 8496 - DNA, 20 bp, Artificial Sequence
  Description of Artificial Sequence: Synthetic oligonucleotide
  Target: AGXT; (-) strand; PAM type: NRG; PAM sequence: GAG
gagagcgccaggtgctggag

SEQ ID NO: 8497 - DNA, 20 bp, Artificial Sequence
  Description of Artificial Sequence: Synthetic oligonucleotide
  Target: AGXT; (-) strand; PAM type: NRG; PAM sequence: AGG
gggagagcgccaggtgctgg

SEQ ID NO: 8498 - DNA, 20 bp, Artificial Sequence
  Description of Artificial Sequence: Synthetic oligonucleotide
  Target: AGXT; (-) strand; PAM type: NRG; PAM sequence: GAG
cgggagagcgccaggtgctg

SEQ ID NO: 8499 - DNA, 20 bp, Artificial Sequence
  Description of Artificial Sequence: Synthetic oligonucleotide
  Target: AGXT; (-) strand; PAM type: NRG; PAM sequence: TGG
ggcgggagagcgccaggtgc

SEQ ID NO: 8500 - DNA, 20 bp, Artificial Sequence
  Description of Artificial Sequence: Synthetic oligonucleotide
  Target: AGXT; (-) strand; PAM type: NRG; PAM sequence: AGG
agggtgggcgggagagcgcc

SEQ ID NO: 8501 - DNA, 20 bp, Artificial Sequence
  Description of Artificial Sequence: Synthetic oligonucleotide
  Target: AGXT; (-) strand; PAM type: NRG; PAM sequence: CAG
gagggtgggcgggagagcgc

SEQ ID NO: 8502 - DNA, 20 bp, Artificial Sequence
  Description of Artificial Sequence: Synthetic oligonucleotide
  Target: AGXT; (-) strand; PAM type: NRG; PAM sequence: GAG
ctcccagagggtgggcggga

SEQ ID NO: 8503 - DNA, 20 bp, Artificial Sequence
  Description of Artificial Sequence: Synthetic oligonucleotide
  Target: AGXT; (-) strand; PAM type: NRG; PAM sequence: GAG
gcctcccagagggtgggcgg

SEQ ID NO: 8504 - DNA, 20 bp, Artificial Sequence
  Description of Artificial Sequence: Synthetic oligonucleotide
  Target: AGXT; (-) strand; PAM type: NRG; PAM sequence: GGG
tggcctcccagagggtgggc

SEQ ID NO: 8505 - DNA, 20 bp, Artificial Sequence
  Description of Artificial Sequence: Synthetic oligonucleotide
  Target: AGXT; (-) strand; PAM type: NRG; PAM sequence: CGG
ttggcctcccagagggtggg

SEQ ID NO: 8506 - DNA, 20 bp, Artificial Sequence
  Description of Artificial Sequence: Synthetic oligonucleotide
  Target: AGXT; (-) strand; PAM type: NRG; PAM sequence: GGG
cctttggcctcccagagggt

SEQ ID NO: 8507 - DNA, 20 bp, Artificial Sequence
  Description of Artificial Sequence: Synthetic oligonucleotide
  Target: AGXT; (-) strand; PAM type: NRG; PAM sequence: TGG
gcctttggcctcccagaggg

SEQ ID NO: 8508 - DNA, 20 bp, Artificial Sequence
  Description of Artificial Sequence: Synthetic oligonucleotide
  Target: AGXT; (-) strand; PAM type: NRG; PAM sequence: GGG
agtgcctttggcctcccaga

SEQ ID NO: 8509 - DNA, 20 bp, Artificial Sequence
  Description of Artificial Sequence: Synthetic oligonucleotide
  Target: AGXT; (-) strand; PAM type: NRG; PAM sequence: AGG
cagtgcctttggcctcccag

SEQ ID NO: 8510 - DNA, 20 bp, Artificial Sequence
  Description of Artificial Sequence: Synthetic oligonucleotide
  Target: AGXT; (-) strand; PAM type: NRG; PAM sequence: GAG
gcagtgcctttggcctccca

SEQ ID NO: 8511 - DNA, 20 bp, Artificial Sequence
  Description of Artificial Sequence: Synthetic oligonucleotide
  Target: AGXT; (-) strand; PAM type: NRG; PAM sequence: CAG
acgcagtgcctttggcctcc

SEQ ID NO: 8512 - DNA, 20 bp, Artificial Sequence
  Description of Artificial Sequence: Synthetic oligonucleotide
  Target: AGXT; (-) strand; PAM type: NRG; PAM sequence: TGG
ccctgtgaacgcagtgcctt

SEQ ID NO: 8513 - DNA, 20 bp, Artificial Sequence
  Description of Artificial Sequence: Synthetic oligonucleotide
  Target: AGXT; (-) strand; PAM type: NRG; PAM sequence: CAG
ctccccactccctgtgaacg

SEQ ID NO: 8514 - DNA, 20 bp, Artificial Sequence
  Description of Artificial Sequence: Synthetic oligonucleotide
  Target: AGXT; (-) strand; PAM type: NRG; PAM sequence: CGG
cctgcagccctcccctcgcc

SEQ ID NO: 8515 - DNA, 20 bp, Artificial Sequence
  Description of Artificial Sequence: Synthetic oligonucleotide
  Target: AGXT; (-) strand; PAM type: NRG; PAM sequence: CAG
ctgcaccctgcacacgcctg

SEQ ID NO: 8516 - DNA, 20 bp, Artificial Sequence
  Description of Artificial Sequence: Synthetic oligonucleotide
  Target: AGXT; (-) strand; PAM type: NRG; PAM sequence: TGG
gctgggaacttccagagcag

SEQ ID NO: 8517 - DNA, 20 bp, Artificial Sequence
  Description of Artificial Sequence: Synthetic oligonucleotide
  Target: AGXT; (-) strand; PAM type: NRG; PAM sequence: CAG
gaagctgggaacttccagag

SEQ ID NO: 8518 - DNA, 20 bp, Artificial Sequence
  Description of Artificial Sequence: Synthetic oligonucleotide
  Target: AGXT; (-) strand; PAM type: NRG; PAM sequence: GAG
tgtgaagctgggaacttcca

SEQ ID NO: 8519 - DNA, 20 bp, Artificial Sequence
  Description of Artificial Sequence: Synthetic oligonucleotide
  Target: AGXT; (-) strand; PAM type: NRG; PAM sequence: CAG
gctgtgaagctgggaacttc

SEQ ID NO: 8520 - DNA, 20 bp, Artificial Sequence
  Description of Artificial Sequence: Synthetic oligonucleotide
  Target: AGXT; (-) strand; PAM type: NRG; PAM sequence: GGG
tcactccttgctgtgaagct

SEQ ID NO: 8521 - DNA, 20 bp, Artificial Sequence
  Description of Artificial Sequence: Synthetic oligonucleotide
  Target: AGXT; (-) strand; PAM type: NRG; PAM sequence: TGG
gtcactccttgctgtgaagc

SEQ ID NO: 8522 - DNA, 20 bp, Artificial Sequence
  Description of Artificial Sequence: Synthetic oligonucleotide
  Target: AGXT; (-) strand; PAM type: NRG; PAM sequence: AAG
cctggtcactccttgctgtg

SEQ ID NO: 8523 - DNA, 20 bp, Artificial Sequence
  Description of Artificial Sequence: Synthetic oligonucleotide
  Target: AGXT; (-) strand; PAM type: NRG; PAM sequence: TGG
tcaggccctcagtcctttcc

SEQ ID NO: 8524 - DNA, 20 bp, Artificial Sequence
  Description of Artificial Sequence: Synthetic oligonucleotide
  Target: AGXT; (-) strand; PAM type: NRG; PAM sequence: CAG
ggcactgggcctcaggccct

SEQ ID NO: 8525 - DNA, 20 bp, Artificial Sequence
  Description of Artificial Sequence: Synthetic oligonucleotide
  Target: AGXT; (-) strand; PAM type: NRG; PAM sequence: AGG
cggtcagggcactgggcctc

SEQ ID NO: 8526 - DNA, 20 bp, Artificial Sequence
  Description of Artificial Sequence: Synthetic oligonucleotide
  Target: AGXT; (-) strand; PAM type: NRG; PAM sequence: CAG
ccggtcagggcactgggcct

SEQ ID NO: 8527 - DNA, 20 bp, Artificial Sequence
  Description of Artificial Sequence: Synthetic oligonucleotide
  Target: AGXT; (-) strand; PAM type: NRG; PAM sequence: GGG
cagaggccggtcagggcact

SEQ ID NO: 8528 - DNA, 20 bp, Artificial Sequence
  Description of Artificial Sequence: Synthetic oligonucleotide
  Target: AGXT; (-) strand; PAM type: NRG; PAM sequence: TGG
gcagaggccggtcagggcac

SEQ ID NO: 8529 - DNA, 20 bp, Artificial Sequence
  Description of Artificial Sequence: Synthetic oligonucleotide
  Target: AGXT; (-) strand; PAM type: NRG; PAM sequence: GGG
gccagggcagaggccggtca

SEQ ID NO: 8530 - DNA, 20 bp, Artificial Sequence
  Description of Artificial Sequence: Synthetic oligonucleotide
  Target: AGXT; (-) strand; PAM type: NRG; PAM sequence: AGG
agccagggcagaggccggtc

SEQ ID NO: 8531 - DNA, 20 bp, Artificial Sequence
  Description of Artificial Sequence: Synthetic oligonucleotide
  Target: AGXT; (-) strand; PAM type: NRG; PAM sequence: CAG
gagccagggcagaggccggt

SEQ ID NO: 8532 - DNA, 20 bp, Artificial Sequence
  Description of Artificial Sequence: Synthetic oligonucleotide
  Target: AGXT; (-) strand; PAM type: NRG; PAM sequence: CGG
agctgagccagggcagaggc

SEQ ID NO: 8533 - DNA, 20 bp, Artificial Sequence
  Description of Artificial Sequence: Synthetic oligonucleotide
  Target: AGXT; (-) strand; PAM type: NRG; PAM sequence: AGG
tggaagctgagccagggcag

SEQ ID NO: 8534 - DNA, 20 bp, Artificial Sequence
  Description of Artificial Sequence: Synthetic oligonucleotide
  Target: AGXT; (-) strand; PAM type: NRG; PAM sequence: GAG
ctggaagctgagccagggca

SEQ ID NO: 8535 - DNA, 20 bp, Artificial Sequence
  Description of Artificial Sequence: Synthetic oligonucleotide
  Target: AGXT; (-) strand; PAM type: NRG; PAM sequence: CAG
ccctggaagctgagccaggg

SEQ ID NO: 8536 - DNA, 20 bp, Artificial Sequence
  Description of Artificial Sequence: Synthetic oligonucleotide
  Target: AGXT; (-) strand; PAM type: NRG; PAM sequence: GGG
agcccctggaagctgagcca

SEQ ID NO: 8537 - DNA, 20 bp, Artificial Sequence
  Description of Artificial Sequence: Synthetic oligonucleotide
  Target: AGXT; (-) strand; PAM type: NRG; PAM sequence: AGG
cagcccctggaagctgagcc

SEQ ID NO: 8538 - DNA, 20 bp, Artificial Sequence
  Description of Artificial Sequence: Synthetic oligonucleotide
  Target: AGXT; (-) strand; PAM type: NRG; PAM sequence: CAG
gcagcccctggaagctgagc

SEQ ID NO: 8539 - DNA, 20 bp, Artificial Sequence
  Description of Artificial Sequence: Synthetic oligonucleotide
  Target: AGXT; (-) strand; PAM type: NRG; PAM sequence: GAG
tggggcagcccctggaagct

SEQ ID NO: 8540 - DNA, 20 bp, Artificial Sequence
  Description of Artificial Sequence: Synthetic oligonucleotide
  Target: AGXT; (-) strand; PAM type: NRG; PAM sequence: AAG
tcccttggggcagcccctgg

SEQ ID NO: 8541 - DNA, 20 bp, Artificial Sequence
  Description of Artificial Sequence: Synthetic oligonucleotide
  Target: AGXT; (-) strand; PAM type: NRG; PAM sequence: TGG
ttgtcccttggggcagcccc

SEQ ID NO: 8542 - DNA, 20 bp, Artificial Sequence
  Description of Artificial Sequence: Synthetic oligonucleotide
  Target: AGXT; (-) strand; PAM type: NRG; PAM sequence: CAG
gcccacgttgtcccttgggg

SEQ ID NO: 8543 - DNA, 20 bp, Artificial Sequence
  Description of Artificial Sequence: Synthetic oligonucleotide
  Target: AGXT; (-) strand; PAM type: NRG; PAM sequence: GGG
gtggcccacgttgtcccttg

SEQ ID NO: 8544 - DNA, 20 bp, Artificial Sequence
  Description of Artificial Sequence: Synthetic oligonucleotide
  Target: AGXT; (-) strand; PAM type: NRG; PAM sequence: GGG
tgtggcccacgttgtccctt

SEQ ID NO: 8545 - DNA, 20 bp, Artificial Sequence
  Description of Artificial Sequence: Synthetic oligonucleotide
  Target: AGXT; (-) strand; PAM type: NRG; PAM sequence: TGG
gtgtggcccacgttgtccct

SEQ ID NO: 8546 - DNA, 20 bp, Artificial Sequence
  Description of Artificial Sequence: Synthetic oligonucleotide
  Target: AGXT; (-) strand; PAM type: NRG; PAM sequence: TGG
actgcagggggcactgtgtg

SEQ ID NO: 8547 - DNA, 20 bp, Artificial Sequence
  Description of Artificial Sequence: Synthetic oligonucleotide
  Target: AGXT; (-) strand; PAM type: NRG; PAM sequence: GGG
ggtgagattgggactgcagg

SEQ ID NO: 8548 - DNA, 20 bp, Artificial Sequence
  Description of Artificial Sequence: Synthetic oligonucleotide
  Target: AGXT; (-) strand; PAM type: NRG; PAM sequence: GGG
aggtgagattgggactgcag

SEQ ID NO: 8549 - DNA, 20 bp, Artificial Sequence
  Description of Artificial Sequence: Synthetic oligonucleotide
  Target: AGXT; (-) strand; PAM type: NRG; PAM sequence: GGG
gaggtgagattgggactgca

SEQ ID NO: 8550 - DNA, 20 bp, Artificial Sequence
  Description of Artificial Sequence: Synthetic oligonucleotide
  Target: AGXT; (-) strand; PAM type: NRG; PAM sequence: AGG
ggaggtgagattgggactgc

SEQ ID NO: 8551 - DNA, 20 bp, Artificial Sequence
  Description of Artificial Sequence: Synthetic oligonucleotide
  Target: AGXT; (-) strand; PAM type: NRG; PAM sequence: CAG
gggaggtgagattgggactg

SEQ ID NO: 8552 - DNA, 20 bp, Artificial Sequence
  Description of Artificial Sequence: Synthetic oligonucleotide
  Target: AGXT; (-) strand; PAM type: NRG; PAM sequence: GGG
caggagcgggaggtgagatt

SEQ ID NO: 8553 - DNA, 20 bp, Artificial Sequence
  Description of Artificial Sequence: Synthetic oligonucleotide
  Target: AGXT; (-) strand; PAM type: NRG; PAM sequence: TGG
ccaggagcgggaggtgagat

SEQ ID NO: 8554 - DNA, 20 bp, Artificial Sequence
  Description of Artificial Sequence: Synthetic oligonucleotide
  Target: AGXT; (-) strand; PAM type: NRG; PAM sequence: GAG
ggacaccaggagcgggaggt

SEQ ID NO: 8555 - DNA, 20 bp, Artificial Sequence
  Description of Artificial Sequence: Synthetic oligonucleotide
  Target: AGXT; (-) strand; PAM type: NRG; PAM sequence: AGG
atctggacaccaggagcggg

SEQ ID NO: 8556 - DNA, 20 bp, Artificial Sequence
  Description of Artificial Sequence: Synthetic oligonucleotide
  Target: AGXT; (-) strand; PAM type: NRG; PAM sequence: GAG
aatctggacaccaggagcgg

SEQ ID NO: 8557 - DNA, 20 bp, Artificial Sequence
  Description of Artificial Sequence: Synthetic oligonucleotide
  Target: AGXT; (-) strand; PAM type: NRG; PAM sequence: GGG
agaatctggacaccaggagc

SEQ ID NO: 8558 - DNA, 20 bp, Artificial Sequence
  Description of Artificial Sequence: Synthetic oligonucleotide
  Target: AGXT; (-) strand; PAM type: NRG; PAM sequence: CGG
cagaatctggacaccaggag

SEQ ID NO: 8559 - DNA, 20 bp, Artificial Sequence
  Description of Artificial Sequence: Synthetic oligonucleotide
  Target: AGXT; (-) strand; PAM type: NRG; PAM sequence: GAG
gctcagaatctggacaccag

SEQ ID NO: 8560 - DNA, 20 bp, Artificial Sequence
  Description of Artificial Sequence: Synthetic oligonucleotide
  Target: AGXT; (-) strand; PAM type: NRG; PAM sequence: AGG
tggctcagaatctggacacc

SEQ ID NO: 8561 - DNA, 20 bp, Artificial Sequence
  Description of Artificial Sequence: Synthetic oligonucleotide
  Target: AGXT; (-) strand; PAM type: NRG; PAM sequence: CAG
ctggctcagaatctggacac

SEQ ID NO: 8562 - DNA, 20 bp, Artificial Sequence
  Description of Artificial Sequence: Synthetic oligonucleotide
  Target: AGXT; (-) strand; PAM type: NRG; PAM sequence: TGG
gcccggcctggctcagaatc

SEQ ID NO: 8563 - DNA, 20 bp, Artificial Sequence
  Description of Artificial Sequence: Synthetic oligonucleotide
  Target: AGXT; (-) strand; PAM type: NRG; PAM sequence: CAG
accccctgcccggcctggct

SEQ ID NO: 8564 - DNA, 20 bp, Artificial Sequence
  Description of Artificial Sequence: Synthetic oligonucleotide
  Target: AGXT; (-) strand; PAM type: NRG; PAM sequence: TGG
cccctaccccctgcccggcc

SEQ ID NO: 8565 - DNA, 20 bp, Artificial Sequence
  Description of Artificial Sequence: Synthetic oligonucleotide
  Target: AGXT; (-) strand; PAM type: NRG; PAM sequence: CGG
cccttcccctaccccctgcc

SEQ ID NO: 8566 - DNA, 20 bp, Artificial Sequence
  Description of Artificial Sequence: Synthetic oligonucleotide
  Target: AGXT; (-) strand; PAM type: NRG; PAM sequence: TGG
tgggaaccgcctgtgaggtc

SEQ ID NO: 8567 - DNA, 20 bp, Artificial Sequence
  Description of Artificial Sequence: Synthetic oligonucleotide
  Target: AGXT; (-) strand; PAM type: NRG; PAM sequence: AGG
ctggatgggaaccgcctgtg

SEQ ID NO: 8568 - DNA, 20 bp, Artificial Sequence
  Description of Artificial Sequence: Synthetic oligonucleotide
  Target: AGXT; (-) strand; PAM type: NRG; PAM sequence: GAG
gctggatgggaaccgcctgt

SEQ ID NO: 8569 - DNA, 20 bp, Artificial Sequence
  Description of Artificial Sequence: Synthetic oligonucleotide
  Target: AGXT; (-) strand; PAM type: NRG; PAM sequence: GGG
ttgccaggctgcagctggat

SEQ ID NO: 8570 - DNA, 20 bp, Artificial Sequence
  Description of Artificial Sequence: Synthetic oligonucleotide
  Target: AGXT; (-) strand; PAM type: NRG; PAM sequence: TGG
gttgccaggctgcagctgga

SEQ ID NO: 8571 - DNA, 20 bp, Artificial Sequence
  Description of Artificial Sequence: Synthetic oligonucleotide
  Target: AGXT; (-) strand; PAM type: NRG; PAM sequence: TGG
tccagttgccaggctgcagc

SEQ ID NO: 8572 - DNA, 20 bp, Artificial Sequence
  Description of Artificial Sequence: Synthetic oligonucleotide
  Target: AGXT; (-) strand; PAM type: NRG; PAM sequence: CAG
cacctccagttgccaggctg

SEQ ID NO: 8573 - DNA, 20 bp, Artificial Sequence
  Description of Artificial Sequence: Synthetic oligonucleotide
  Target: AGXT; (-) strand; PAM type: NRG; PAM sequence: AGG
gaacggcacctccagttgcc

SEQ ID NO: 8574 - DNA, 20 bp, Artificial Sequence
  Description of Artificial Sequence: Synthetic oligonucleotide
  Target: AGXT; (-) strand; PAM type: NRG; PAM sequence: CAG
ggaacggcacctccagttgc

SEQ ID NO: 8575 - DNA, 20 bp, Artificial Sequence
  Description of Artificial Sequence: Synthetic oligonucleotide
  Target: AGXT; (-) strand; PAM type: NRG; PAM sequence: CAG
gttctggggaacggcacctc

SEQ ID NO: 8576 - DNA, 20 bp, Artificial Sequence
  Description of Artificial Sequence: Synthetic oligonucleotide
  Target: AGXT; (-) strand; PAM type: NRG; PAM sequence: CGG
gtcctctctgttctggggaa

SEQ ID NO: 8577 - DNA, 20 bp, Artificial Sequence
  Description of Artificial Sequence: Synthetic oligonucleotide
  Target: AGXT; (-) strand; PAM type: NRG; PAM sequence: GGG
ccgaagtcctctctgttctg

SEQ ID NO: 8578 - DNA, 20 bp, Artificial Sequence
  Description of Artificial Sequence: Synthetic oligonucleotide
  Target: AGXT; (-) strand; PAM type: NRG; PAM sequence: GGG
cccgaagtcctctctgttct

SEQ ID NO: 8579 - DNA, 20 bp, Artificial Sequence
  Description of Artificial Sequence: Synthetic oligonucleotide
  Target: AGXT; (-) strand; PAM type: NRG; PAM sequence: TGG
ccccgaagtcctctctgttc

SEQ ID NO: 8580 - DNA, 20 bp, Artificial Sequence
  Description of Artificial Sequence: Synthetic oligonucleotide
  Target: AGXT; (-) strand; PAM type: NRG; PAM sequence: AAG
gaattcctgacttctccccg

SEQ ID NO: 8581 - DNA, 20 bp, Artificial Sequence
  Description of Artificial Sequence: Synthetic oligonucleotide
  Target: AGXT; (-) strand; PAM type: NRG; PAM sequence: CAG
gtgtggtccagctggcatct

SEQ ID NO: 8582 - DNA, 20 bp, Artificial Sequence
  Description of Artificial Sequence: Synthetic oligonucleotide
  Target: AGXT; (-) strand; PAM type: NRG; PAM sequence: TGG
accctcccgtgtggtccagc

SEQ ID NO: 8583 - DNA, 20 bp, Artificial Sequence
  Description of Artificial Sequence: Synthetic oligonucleotide
  Target: AGXT; (-) strand; PAM type: NRG; PAM sequence: CAG
cttcaccctcccgtgtggtc

SEQ ID NO: 8584 - DNA, 20 bp, Artificial Sequence
  Description of Artificial Sequence: Synthetic oligonucleotide
  Target: AGXT; (-) strand; PAM type: NRG; PAM sequence: TGG
gcttccttcaccctcccgtg

SEQ ID NO: 8585 - DNA, 20 bp, Artificial Sequence
  Description of Artificial Sequence: Synthetic oligonucleotide
  Target: AGXT; (-) strand; PAM type: NRG; PAM sequence: CAG
ccaggctcctgactcacacc

SEQ ID NO: 8586 - DNA, 20 bp, Artificial Sequence
  Description of Artificial Sequence: Synthetic oligonucleotide
  Target: AGXT; (-) strand; PAM type: NRG; PAM sequence: AGG
gccagccccggcctctcccc

SEQ ID NO: 8587 - DNA, 20 bp, Artificial Sequence
  Description of Artificial Sequence: Synthetic oligonucleotide
  Target: AGXT; (-) strand; PAM type: NRG; PAM sequence: CAG
ggccagccccggcctctccc

SEQ ID NO: 8588 - DNA, 20 bp, Artificial Sequence
  Description of Artificial Sequence: Synthetic oligonucleotide
  Target: AGXT; (-) strand; PAM type: NRG; PAM sequence: CGG
ccagatggaggggccagccc

SEQ ID NO: 8589 - DNA, 20 bp, Artificial Sequence
  Description of Artificial Sequence: Synthetic oligonucleotide
  Target: AGXT; (-) strand; PAM type: NRG; PAM sequence: CAG
acaactccagatggaggggc

SEQ ID NO: 8590 - DNA, 20 bp, Artificial Sequence
  Description of Artificial Sequence: Synthetic oligonucleotide
  Target: AGXT; (-) strand; PAM type: NRG; PAM sequence: GGG
ctctacaactccagatggag

SEQ ID NO: 8591 - DNA, 20 bp, Artificial Sequence
  Description of Artificial Sequence: Synthetic oligonucleotide
  Target: AGXT; (-) strand; PAM type: NRG; PAM sequence: GGG
tctctacaactccagatgga

SEQ ID NO: 8592 - DNA, 20 bp, Artificial Sequence
  Description of Artificial Sequence: Synthetic oligonucleotide
  Target: AGXT; (-) strand; PAM type: NRG; PAM sequence: AGG
gtctctacaactccagatgg

SEQ ID NO: 8593 - DNA, 20 bp, Artificial Sequence
  Description of Artificial Sequence: Synthetic oligonucleotide
  Target: AGXT; (-) strand; PAM type: NRG; PAM sequence: GAG
cgtctctacaactccagatg

SEQ ID NO: 8594 - DNA, 20 bp, Artificial Sequence
  Description of Artificial Sequence: Synthetic oligonucleotide
  Target: AGXT; (-) strand; PAM type: NRG; PAM sequence: TGG
tccgtctctacaactccaga

SEQ ID NO: 8595 - DNA, 20 bp, Artificial Sequence
  Description of Artificial Sequence: Synthetic oligonucleotide
  Target: AGXT; (-) strand; PAM type: NRG; PAM sequence: CAG
tgtgtccgtctctacaactc

SEQ ID NO: 8596 - DNA, 20 bp, Artificial Sequence
  Description of Artificial Sequence: Synthetic oligonucleotide
  Target: AGXT; (-) strand; PAM type: NRG; PAM sequence: AGG
ggccccaggggacactggcc

SEQ ID NO: 8597 - DNA, 20 bp, Artificial Sequence
  Description of Artificial Sequence: Synthetic oligonucleotide
  Target: AGXT; (-) strand; PAM type: NRG; PAM sequence: CAG
gggccccaggggacactggc

SEQ ID NO: 8598 - DNA, 20 bp, Artificial Sequence
  Description of Artificial Sequence: Synthetic oligonucleotide
  Target: AGXT; (-) strand; PAM type: NRG; PAM sequence: TGG
tttcgggccccaggggacac

SEQ ID NO: 8599 - DNA, 20 bp, Artificial Sequence
  Description of Artificial Sequence: Synthetic oligonucleotide
  Target: AGXT; (-) strand; PAM type: NRG; PAM sequence: GGG
tgactgctttcgggccccag

SEQ ID NO: 8600 - DNA, 20 bp, Artificial Sequence
  Description of Artificial Sequence: Synthetic oligonucleotide
  Target: AGXT; (-) strand; PAM type: NRG; PAM sequence: GGG
gtgactgctttcgggcccca

SEQ ID NO: 8601 - DNA, 20 bp, Artificial Sequence
  Description of Artificial Sequence: Synthetic oligonucleotide
  Target: AGXT; (-) strand; PAM type: NRG; PAM sequence: AGG
ggtgactgctttcgggcccc

SEQ ID NO: 8602 - DNA, 20 bp, Artificial Sequence
  Description of Artificial Sequence: Synthetic oligonucleotide
  Target: AGXT; (-) strand; PAM type: NRG; PAM sequence: CAG
aggtgactgctttcgggccc

SEQ ID NO: 8603 - DNA, 20 bp, Artificial Sequence
  Description of Artificial Sequence: Synthetic oligonucleotide
  Target: AGXT; (-) strand; PAM type: NRG; PAM sequence: GGG
acccaaaggtgactgctttc

SEQ ID NO: 8604 - DNA, 20 bp, Artificial Sequence
  Description of Artificial Sequence: Synthetic oligonucleotide
  Target: AGXT; (-) strand; PAM type: NRG; PAM sequence: CGG
cacccaaaggtgactgcttt

SEQ ID NO: 8605 - DNA, 20 bp, Artificial Sequence
  Description of Artificial Sequence: Synthetic oligonucleotide
  Target: AGXT; (-) strand; PAM type: NRG; PAM sequence: AGG
tcatttctcacatcacccaa

SEQ ID NO: 8606 - DNA, 20 bp, Artificial Sequence
  Description of Artificial Sequence: Synthetic oligonucleotide
  Target: AGXT; (-) strand; PAM type: NRG; PAM sequence: AAG
ttcatttctcacatcaccca

SEQ ID NO: 8607 - DNA, 20 bp, Artificial Sequence
  Description of Artificial Sequence: Synthetic oligonucleotide
  Target: AGXT; (-) strand; PAM type: NRG; PAM sequence: CAG
cccagcccctcctacagggt

SEQ ID NO: 8608 - DNA, 20 bp, Artificial Sequence
  Description of Artificial Sequence: Synthetic oligonucleotide
  Target: AGXT; (-) strand; PAM type: NRG; PAM sequence: GGG
ctcccccagcccctcctaca

SEQ ID NO: 8609 - DNA, 20 bp, Artificial Sequence
  Description of Artificial Sequence: Synthetic oligonucleotide
  Target: AGXT; (-) strand; PAM type: NRG; PAM sequence: AGG
tctcccccagcccctcctac

SEQ ID NO: 8610 - DNA, 20 bp, Artificial Sequence
  Description of Artificial Sequence: Synthetic oligonucleotide
  Target: AGXT; (-) strand; PAM type: NRG; PAM sequence: CAG
ctctcccccagcccctccta

SEQ ID NO: 8611 - DNA, 20 bp, Artificial Sequence
  Description of Artificial Sequence: Synthetic oligonucleotide
  Target: AGXT; (-) strand; PAM type: NRG; PAM sequence: CAG
gtgtgcccctttctctcccc

SEQ ID NO: 8612 - DNA, 20 bp, Artificial Sequence
  Description of Artificial Sequence: Synthetic oligonucleotide
  Target: AGXT; (-) strand; PAM type: NRG; PAM sequence: CAG
tgccatgggggcaccaaggc

SEQ ID NO: 8613 - DNA, 20 bp, Artificial Sequence
  Description of Artificial Sequence: Synthetic oligonucleotide
  Target: AGXT; (-) strand; PAM type: NRG; PAM sequence: AGG
accctgccatgggggcacca

SEQ ID NO: 8614 - DNA, 20 bp, Artificial Sequence
  Description of Artificial Sequence: Synthetic oligonucleotide
  Target: AGXT; (-) strand; PAM type: NRG; PAM sequence: AAG
gaccctgccatgggggcacc

SEQ ID NO: 8615 - DNA, 20 bp, Artificial Sequence
  Description of Artificial Sequence: Synthetic oligonucleotide
  Target: AGXT; (-) strand; PAM type: NRG; PAM sequence: GGG
gctgtgtgaccctgccatgg

SEQ ID NO: 8616 - DNA, 20 bp, Artificial Sequence
  Description of Artificial Sequence: Synthetic oligonucleotide
  Target: AGXT; (-) strand; PAM type: NRG; PAM sequence: GGG
agctgtgtgaccctgccatg

SEQ ID NO: 8617 - DNA, 20 bp, Artificial Sequence
  Description of Artificial Sequence: Synthetic oligonucleotide
  Target: AGXT; (-) strand; PAM type: NRG; PAM sequence: GGG
cagctgtgtgaccctgccat

SEQ ID NO: 8618 - DNA, 20 bp, Artificial Sequence
  Description of Artificial Sequence: Synthetic oligonucleotide
  Target: AGXT; (-) strand; PAM type: NRG; PAM sequence: TGG
ccagctgtgtgaccctgcca

SEQ ID NO: 8619 - DNA, 20 bp, Artificial Sequence
  Description of Artificial Sequence: Synthetic oligonucleotide
  Target: AGXT; (-) strand; PAM type: NRG; PAM sequence: CAG
gtcccgctggcccttgggcc

SEQ ID NO: 8620 - DNA, 20 bp, Artificial Sequence
  Description of Artificial Sequence: Synthetic oligonucleotide
  Target: AGXT; (-) strand; PAM type: NRG; PAM sequence: GGG
gtccagtcccgctggccctt

SEQ ID NO: 8621 - DNA, 20 bp, Artificial Sequence
  Description of Artificial Sequence: Synthetic oligonucleotide
  Target: AGXT; (-) strand; PAM type: NRG; PAM sequence: TGG
tgtccagtcccgctggccct

SEQ ID NO: 8622 - DNA, 20 bp, Artificial Sequence
  Description of Artificial Sequence: Synthetic oligonucleotide
  Target: AGXT; (-) strand; PAM type: NRG; PAM sequence: TGG
cctcagctgtccagtcccgc

SEQ ID NO: 8623 - DNA, 20 bp, Artificial Sequence
  Description of Artificial Sequence: Synthetic oligonucleotide
  Target: AGXT; (-) strand; PAM type: NRG; PAM sequence: CAG
tcgtgggtccctcagctgtc

SEQ ID NO: 8624 - DNA, 20 bp, Artificial Sequence
  Description of Artificial Sequence: Synthetic oligonucleotide
  Target: AGXT; (-) strand; PAM type: NRG; PAM sequence: CAG
cgggtgggtcgtgggtccct

SEQ ID NO: 8625 - DNA, 20 bp, Artificial Sequence
  Description of Artificial Sequence: Synthetic oligonucleotide
  Target: AGXT; (-) strand; PAM type: NRG; PAM sequence: GGG
agtgggaccgggtgggtcgt

SEQ ID NO: 8626 - DNA, 20 bp, Artificial Sequence
  Description of Artificial Sequence: Synthetic oligonucleotide
  Target: AGXT; (-) strand; PAM type: NRG; PAM sequence: TGG
gagtgggaccgggtgggtcg

SEQ ID NO: 8627 - DNA, 20 bp, Artificial Sequence
  Description of Artificial Sequence: Synthetic oligonucleotide
  Target: AGXT; (-) strand; PAM type: NRG; PAM sequence: GGG
gggccagagtgggaccgggt

SEQ ID NO: 8628 - DNA, 20 bp, Artificial Sequence
  Description of Artificial Sequence: Synthetic oligonucleotide
  Target: AGXT; (-) strand; PAM type: NRG; PAM sequence: TGG
ggggccagagtgggaccggg

SEQ ID NO: 8629 - DNA, 20 bp, Artificial Sequence
  Description of Artificial Sequence: Synthetic oligonucleotide
  Target: AGXT; (-) strand; PAM type: NRG; PAM sequence: GGG
tcaggggccagagtgggacc

SEQ ID NO: 8630 - DNA, 20 bp, Artificial Sequence
  Description of Artificial Sequence: Synthetic oligonucleotide
  Target: AGXT; (-) strand; PAM type: NRG; PAM sequence: CGG
ctcaggggccagagtgggac

SEQ ID NO: 8631 - DNA, 20 bp, Artificial Sequence
  Description of Artificial Sequence: Synthetic oligonucleotide
  Target: AGXT; (-) strand; PAM type: NRG; PAM sequence: GGG
ttgtgctcaggggccagagt

SEQ ID NO: 8632 - DNA, 20 bp, Artificial Sequence
  Description of Artificial Sequence: Synthetic oligonucleotide
  Target: AGXT; (-) strand; PAM type: NRG; PAM sequence: TGG
tttgtgctcaggggccagag

SEQ ID NO: 8633 - DNA, 20 bp, Artificial Sequence
  Description of Artificial Sequence: Synthetic oligonucleotide
  Target: AGXT; (-) strand; PAM type: NRG; PAM sequence: GAG
gcatttgtgctcaggggcca

SEQ ID NO: 8634 - DNA, 20 bp, Artificial Sequence
  Description of Artificial Sequence: Synthetic oligonucleotide
  Target: AGXT; (-) strand; PAM type: NRG; PAM sequence: CAG
ctgcatttgtgctcaggggc

SEQ ID NO: 8635 - DNA, 20 bp, Artificial Sequence
  Description of Artificial Sequence: Synthetic oligonucleotide
  Target: AGXT; (-) strand; PAM type: NRG; PAM sequence: GGG
ccagctgcatttgtgctcag

SEQ ID NO: 8636 - DNA, 20 bp, Artificial Sequence
  Description of Artificial Sequence: Synthetic oligonucleotide
  Target: AGXT; (-) strand; PAM type: NRG; PAM sequence: GGG
cccagctgcatttgtgctca

SEQ ID NO: 8637 - DNA, 20 bp, Artificial Sequence
  Description of Artificial Sequence: Synthetic oligonucleotide
  Target: AGXT; (-) strand; PAM type: NRG; PAM sequence: AGG
ccccagctgcatttgtgctc

SEQ ID NO: 8638 - DNA, 20 bp, Artificial Sequence
  Description of Artificial Sequence: Synthetic oligonucleotide
  Target: AGXT; (-) strand; PAM type: NRG; PAM sequence: CAG
gccccagctgcatttgtgct

SEQ ID NO: 8639 - DNA, 20 bp, Artificial Sequence
  Description of Artificial Sequence: Synthetic oligonucleotide
  Target: AGXT; (-) strand; PAM type: NRG; PAM sequence: CAG
gcccccaggagggcccgccc

SEQ ID NO: 8640 - DNA, 20 bp, Artificial Sequence
  Description of Artificial Sequence: Synthetic oligonucleotide
  Target: AGXT; (-) strand; PAM type: NRG; PAM sequence: GGG
acggggtggggcccccagga

SEQ ID NO: 8641 - DNA, 20 bp, Artificial Sequence
  Description of Artificial Sequence: Synthetic oligonucleotide
  Target: AGXT; (-) strand; PAM type: NRG; PAM sequence: AGG
gacggggtggggcccccagg

SEQ ID NO: 8642 - DNA, 20 bp, Artificial Sequence
  Description of Artificial Sequence: Synthetic oligonucleotide
  Target: AGXT; (-) strand; PAM type: NRG; PAM sequence: GAG
agacggggtggggcccccag

SEQ ID NO: 8643 - DNA, 20 bp, Artificial Sequence
  Description of Artificial Sequence: Synthetic oligonucleotide
  Target: AGXT; (-) strand; PAM type: NRG; PAM sequence: AGG
tgagacggggtggggccccc

SEQ ID NO: 8644 - DNA, 20 bp, Artificial Sequence
  Description of Artificial Sequence: Synthetic oligonucleotide
  Target: AGXT; (-) strand; PAM type: NRG; PAM sequence: CAG
gtgagacggggtggggcccc

SEQ ID NO: 8645 - DNA, 20 bp, Artificial Sequence
  Description of Artificial Sequence: Synthetic oligonucleotide
  Target: AGXT; (-) strand; PAM type: NRG; PAM sequence: GGG
cacgggagtgagacggggtg

SEQ ID NO: 8646 - DNA, 20 bp, Artificial Sequence
  Description of Artificial Sequence: Synthetic oligonucleotide
  Target: AGXT; (-) strand; PAM type: NRG; PAM sequence: GGG
tcacgggagtgagacggggt

SEQ ID NO: 8647 - DNA, 20 bp, Artificial Sequence
  Description of Artificial Sequence: Synthetic oligonucleotide
  Target: AGXT; (-) strand; PAM type: NRG; PAM sequence: TGG
ttcacgggagtgagacgggg

SEQ ID NO: 8648 - DNA, 20 bp, Artificial Sequence
  Description of Artificial Sequence: Synthetic oligonucleotide
  Target: AGXT; (-) strand; PAM type: NRG; PAM sequence: GGG
tgtttcacgggagtgagacg

SEQ ID NO: 8649 - DNA, 20 bp, Artificial Sequence
  Description of Artificial Sequence: Synthetic oligonucleotide
  Target: AGXT; (-) strand; PAM type: NRG; PAM sequence: GGG
ctgtttcacgggagtgagac

SEQ ID NO: 8650 - DNA, 20 bp, Artificial Sequence
  Description of Artificial Sequence: Synthetic oligonucleotide
  Target: AGXT; (-) strand; PAM type: NRG; PAM sequence: CGG
cctgtttcacgggagtgaga

SEQ ID NO: 8651 - DNA, 20 bp, Artificial Sequence
  Description of Artificial Sequence: Synthetic oligonucleotide
  Target: AGXT; (-) strand; PAM type: NRG; PAM sequence: GAG
ctgtcctgtttcacgggagt

SEQ ID NO: 8652 - DNA, 20 bp, Artificial Sequence
  Description of Artificial Sequence: Synthetic oligonucleotide
  Target: AGXT; (-) strand; PAM type: NRG; PAM sequence: GAG
ctggctgtcctgtttcacgg

SEQ ID NO: 8653 - DNA, 20 bp, Artificial Sequence
  Description of Artificial Sequence: Synthetic oligonucleotide
  Target: AGXT; (-) strand; PAM type: NRG; PAM sequence: GGG
cgctggctgtcctgtttcac

SEQ ID NO: 8654 - DNA, 20 bp, Artificial Sequence
  Description of Artificial Sequence: Synthetic oligonucleotide
  Target: AGXT; (-) strand; PAM type: NRG; PAM sequence: CGG
tcgctggctgtcctgtttca

SEQ ID NO: 8655 - DNA, 20 bp, Artificial Sequence
  Description of Artificial Sequence: Synthetic oligonucleotide
  Target: AGXT; (-) strand; PAM type: NRG; PAM sequence: TGG
gaaggccagggcagtctcgc

SEQ ID NO: 8656 - DNA, 20 bp, Artificial Sequence
  Description of Artificial Sequence: Synthetic oligonucleotide
  Target: AGXT; (-) strand; PAM type: NRG; PAM sequence: CAG
gtttgggctgaaggccaggg

SEQ ID NO: 8657 - DNA, 20 bp, Artificial Sequence
  Description of Artificial Sequence: Synthetic oligonucleotide
  Target: AGXT; (-) strand; PAM type: NRG; PAM sequence: GGG
tcagtttgggctgaaggcca

SEQ ID NO: 8658 - DNA, 20 bp, Artificial Sequence
  Description of Artificial Sequence: Synthetic oligonucleotide
  Target: AGXT; (-) strand; PAM type: NRG; PAM sequence: AGG
ctcagtttgggctgaaggcc

SEQ ID NO: 8659 - DNA, 20 bp, Artificial Sequence
  Description of Artificial Sequence: Synthetic oligonucleotide
  Target: AGXT; (-) strand; PAM type: NRG; PAM sequence: CAG
tctcagtttgggctgaaggc

SEQ ID NO: 8660 - DNA, 20 bp, Artificial Sequence
  Description of Artificial Sequence: Synthetic oligonucleotide
  Target: AGXT; (-) strand; PAM type: NRG; PAM sequence: AGG
agcctctcagtttgggctga

SEQ ID NO: 8661 - DNA, 20 bp, Artificial Sequence
  Description of Artificial Sequence: Synthetic oligonucleotide
  Target: AGXT; (-) strand; PAM type: NRG; PAM sequence: AAG
cagcctctcagtttgggctg

SEQ ID NO: 8662 - DNA, 20 bp, Artificial Sequence
  Description of Artificial Sequence: Synthetic oligonucleotide
  Target: AGXT; (-) strand; PAM type: NRG; PAM sequence: GGG
gagcaccagcctctcagttt

SEQ ID NO: 8663 - DNA, 20 bp, Artificial Sequence
  Description of Artificial Sequence: Synthetic oligonucleotide
  Target: AGXT; (-) strand; PAM type: NRG; PAM sequence: TGG
tgagcaccagcctctcagtt

SEQ ID NO: 8664 - DNA, 20 bp, Artificial Sequence
  Description of Artificial Sequence: Synthetic oligonucleotide
  Target: AGXT; (-) strand; PAM type: NRG; PAM sequence: CAG
caggctgagcaccagcctct

SEQ ID NO: 8665 - DNA, 20 bp, Artificial Sequence
  Description of Artificial Sequence: Synthetic oligonucleotide
  Target: AGXT; (-) strand; PAM type: NRG; PAM sequence: CAG
gaaagaagcaggctgagcac

SEQ ID NO: 8666 - DNA, 20 bp, Artificial Sequence
  Description of Artificial Sequence: Synthetic oligonucleotide
  Target: AGXT; (-) strand; PAM type: NRG; PAM sequence: GAG
tggggagaaagaagcaggct

SEQ ID NO: 8667 - DNA, 20 bp, Artificial Sequence
  Description of Artificial Sequence: Synthetic oligonucleotide
  Target: AGXT; (-) strand; PAM type: NRG; PAM sequence: AGG
ctttctggggagaaagaagc

SEQ ID NO: 8668 - DNA, 20 bp, Artificial Sequence
  Description of Artificial Sequence: Synthetic oligonucleotide
  Target: AGXT; (-) strand; PAM type: NRG; PAM sequence: CAG
tctttctggggagaaagaag

SEQ ID NO: 8669 - DNA, 20 bp, Artificial Sequence
  Description of Artificial Sequence: Synthetic oligonucleotide
  Target: AGXT; (-) strand; PAM type: NRG; PAM sequence: AAG
tcttctttctggggagaaag

SEQ ID NO: 8670 - DNA, 20 bp, Artificial Sequence
  Description of Artificial Sequence: Synthetic oligonucleotide
  Target: AGXT; (-) strand; PAM type: NRG; PAM sequence: AAG
acatcttctttctggggaga

SEQ ID NO: 8671 - DNA, 20 bp, Artificial Sequence
  Description of Artificial Sequence: Synthetic oligonucleotide
  Target: AGXT; (-) strand; PAM type: NRG; PAM sequence: GAG
gagtacatcttctttctggg

SEQ ID NO: 8672 - DNA, 20 bp, Artificial Sequence
  Description of Artificial Sequence: Synthetic oligonucleotide
  Target: AGXT; (-) strand; PAM type: NRG; PAM sequence: GGG
gggagtacatcttctttctg

SEQ ID NO: 8673 - DNA, 20 bp, Artificial Sequence
  Description of Artificial Sequence: Synthetic oligonucleotide
  Target: AGXT; (-) strand; PAM type: NRG; PAM sequence: GGG
cgggagtacatcttctttct

SEQ ID NO: 8674 - DNA, 20 bp, Artificial Sequence
  Description of Artificial Sequence: Synthetic oligonucleotide
  Target: AGXT; (-) strand; PAM type: NRG; PAM sequence: TGG
gcgggagtacatcttctttc

SEQ ID NO: 8675 - DNA, 20 bp, Artificial Sequence
  Description of Artificial Sequence: Synthetic oligonucleotide
  Target: AGXT; (-) strand; PAM type: NRG; PAM sequence: GAG
agaagggcttcgtcttgcgg

SEQ ID NO: 8676 - DNA, 20 bp, Artificial Sequence
  Description of Artificial Sequence: Synthetic oligonucleotide
  Target: AGXT; (-) strand; PAM type: NRG; PAM sequence: GGG
ggagaagggcttcgtcttgc

SEQ ID NO: 8677 - DNA, 20 bp, Artificial Sequence
  Description of Artificial Sequence: Synthetic oligonucleotide
  Target: AGXT; (-) strand; PAM type: NRG; PAM sequence: CGG
aggagaagggcttcgtcttg

SEQ ID NO: 8678 - DNA, 20 bp, Artificial Sequence
  Description of Artificial Sequence: Synthetic oligonucleotide
  Target: AGXT; (-) strand; PAM type: NRG; PAM sequence: GGG
atgtccaggtagaaggagaa

SEQ ID NO: 8679 - DNA, 20 bp, Artificial Sequence
  Description of Artificial Sequence: Synthetic oligonucleotide
  Target: AGXT; (-) strand; PAM type: NRG; PAM sequence: AGG
gatgtccaggtagaaggaga

SEQ ID NO: 8680 - DNA, 20 bp, Artificial Sequence
  Description of Artificial Sequence: Synthetic oligonucleotide
  Target: AGXT; (-) strand; PAM type: NRG; PAM sequence: AAG
tgatgtccaggtagaaggag

SEQ ID NO: 8681 - DNA, 20 bp, Artificial Sequence
  Description of Artificial Sequence: Synthetic oligonucleotide
  Target: AGXT; (-) strand; PAM type: NRG; PAM sequence: GAG
acttgatgtccaggtagaag

SEQ ID NO: 8682 - DNA, 20 bp, Artificial Sequence
  Description of Artificial Sequence: Synthetic oligonucleotide
  Target: AGXT; (-) strand; PAM type: NRG; PAM sequence: AGG
ccacttgatgtccaggtaga

SEQ ID NO: 8683 - DNA, 20 bp, Artificial Sequence
  Description of Artificial Sequence: Synthetic oligonucleotide
  Target: AGXT; (-) strand; PAM type: NRG; PAM sequence: AAG
gccacttgatgtccaggtag

SEQ ID NO: 8684 - DNA, 20 bp, Artificial Sequence
  Description of Artificial Sequence: Synthetic oligonucleotide
  Target: AGXT; (-) strand; PAM type: NRG; PAM sequence: TAG
ccagccacttgatgtccagg

SEQ ID NO: 8685 - DNA, 20 bp, Artificial Sequence
  Description of Artificial Sequence: Synthetic oligonucleotide
  Target: AGXT; (-) strand; PAM type: NRG; PAM sequence: AGG
tggccagccacttgatgtcc

SEQ ID NO: 8686 - DNA, 20 bp, Artificial Sequence
  Description of Artificial Sequence: Synthetic oligonucleotide
  Target: AGXT; (-) strand; PAM type: NRG; PAM sequence: CAG
ttggccagccacttgatgtc

SEQ ID NO: 8687 - DNA, 20 bp, Artificial Sequence
  Description of Artificial Sequence: Synthetic oligonucleotide
  Target: AGXT; (-) strand; PAM type: NRG; PAM sequence: CAG
tcacagccccagaagttggc

SEQ ID NO: 8688 - DNA, 20 bp, Artificial Sequence
  Description of Artificial Sequence: Synthetic oligonucleotide
  Target: AGXT; (-) strand; PAM type: NRG; PAM sequence: TGG
gtcgtcacagccccagaagt

SEQ ID NO: 8689 - DNA, 20 bp, Artificial Sequence
  Description of Artificial Sequence: Synthetic oligonucleotide
  Target: AGXT; (-) strand; PAM type: NRG; PAM sequence: AAG
gctggtcgtcacagccccag

SEQ ID NO: 8690 - DNA, 20 bp, Artificial Sequence
  Description of Artificial Sequence: Synthetic oligonucleotide
  Target: AGXT; (-) strand; PAM type: NRG; PAM sequence: CAG
tgggctggtcgtcacagccc

SEQ ID NO: 8691 - DNA, 20 bp, Artificial Sequence
  Description of Artificial Sequence: Synthetic oligonucleotide
  Target: AGXT; (-) strand; PAM type: NRG; PAM sequence: CAG
acatcctgggctggtcgtca

SEQ ID NO: 8692 - DNA, 20 bp, Artificial Sequence
  Description of Artificial Sequence: Synthetic oligonucleotide
  Target: AGXT; (-) strand; PAM type: NRG; PAM sequence: TGG
ccaggcctcacatcctgggc

SEQ ID NO: 8693 - DNA, 20 bp, Artificial Sequence
  Description of Artificial Sequence: Synthetic oligonucleotide
  Target: AGXT; (-) strand; PAM type: NRG; PAM sequence: GGG
cctgccaggcctcacatcct

SEQ ID NO: 8694 - DNA, 20 bp, Artificial Sequence
  Description of Artificial Sequence: Synthetic oligonucleotide
  Target: AGXT; (-) strand; PAM type: NRG; PAM sequence: TGG
ccctgccaggcctcacatcc

SEQ ID NO: 8695 - DNA, 20 bp, Artificial Sequence
  Description of Artificial Sequence: Synthetic oligonucleotide
  Target: AGXT; (-) strand; PAM type: NRG; PAM sequence: AGG
tccaccttcccatccctgcc

SEQ ID NO: 8696 - DNA, 20 bp, Artificial Sequence
  Description of Artificial Sequence: Synthetic oligonucleotide
  Target: AGXT; (-) strand; PAM type: NRG; PAM sequence: CAG
ctccaccttcccatccctgc

SEQ ID NO: 8697 - DNA, 20 bp, Artificial Sequence
  Description of Artificial Sequence: Synthetic oligonucleotide
  Target: AGXT; (-) strand; PAM type: NRG; PAM sequence: CAG
ccccacctctcagccatgcc

SEQ ID NO: 8698 - DNA, 20 bp, Artificial Sequence
  Description of Artificial Sequence: Synthetic oligonucleotide
  Target: AGXT; (-) strand; PAM type: NRG; PAM sequence: CAG
gaggccagcgccccacctct

SEQ ID NO: 8699 - DNA, 20 bp, Artificial Sequence
  Description of Artificial Sequence: Synthetic oligonucleotide
  Target: AGXT; (-) strand; PAM type: NRG; PAM sequence: CAG
ccctgagtgcagtgagaggc

SEQ ID NO: 8700 - DNA, 20 bp, Artificial Sequence
  Description of Artificial Sequence: Synthetic oligonucleotide
  Target: AGXT; (-) strand; PAM type: NRG; PAM sequence: AGG
gaatccctgagtgcagtgag

SEQ ID NO: 8701 - DNA, 20 bp, Artificial Sequence
  Description of Artificial Sequence: Synthetic oligonucleotide
  Target: AGXT; (-) strand; PAM type: NRG; PAM sequence: GAG
agaatccctgagtgcagtga

SEQ ID NO: 8702 - DNA, 20 bp, Artificial Sequence
  Description of Artificial Sequence: Synthetic oligonucleotide
  Target: AGXT; (-) strand; PAM type: NRG; PAM sequence: GAG
ggagaatccctgagtgcagt

SEQ ID NO: 8703 - DNA, 20 bp, Artificial Sequence
  Description of Artificial Sequence: Synthetic oligonucleotide
  Target: AGXT; (-) strand; PAM type: NRG; PAM sequence: CAG
gcttggagaatccctgagtg

SEQ ID NO: 8704 - DNA, 20 bp, Artificial Sequence
  Description of Artificial Sequence: Synthetic oligonucleotide
  Target: AGXT; (-) strand; PAM type: NRG; PAM sequence: GAG
ggggggcttggagaatccct

SEQ ID NO: 8705 - DNA, 20 bp, Artificial Sequence
  Description of Artificial Sequence: Synthetic oligonucleotide
  Target: AGXT; (-) strand; PAM type: NRG; PAM sequence: GAG
gcatgaaggtggggggcttg

SEQ ID NO: 8706 - DNA, 20 bp, Artificial Sequence
  Description of Artificial Sequence: Synthetic oligonucleotide
  Target: AGXT; (-) strand; PAM type: NRG; PAM sequence: TGG
aggcatgaaggtggggggct

SEQ ID NO: 8707 - DNA, 20 bp, Artificial Sequence
  Description of Artificial Sequence: Synthetic oligonucleotide
  Target: AGXT; (-) strand; PAM type: NRG; PAM sequence: GGG
tcttgaggcatgaaggtggg

SEQ ID NO: 8708 - DNA, 20 bp, Artificial Sequence
  Description of Artificial Sequence: Synthetic oligonucleotide
  Target: AGXT; (-) strand; PAM type: NRG; PAM sequence: GGG
ttcttgaggcatgaaggtgg

SEQ ID NO: 8709 - DNA, 20 bp, Artificial Sequence
  Description of Artificial Sequence: Synthetic oligonucleotide
  Target: AGXT; (-) strand; PAM type: NRG; PAM sequence: GGG
gttcttgaggcatgaaggtg

SEQ ID NO: 8710 - DNA, 20 bp, Artificial Sequence
  Description of Artificial Sequence: Synthetic oligonucleotide
  Target: AGXT; (-) strand; PAM type: NRG; PAM sequence: GGG
ggttcttgaggcatgaaggt

SEQ ID NO: 8711 - DNA, 20 bp, Artificial Sequence
  Description of Artificial Sequence: Synthetic oligonucleotide
  Target: AGXT; (-) strand; PAM type: NRG; PAM sequence: TGG
gggttcttgaggcatgaagg

SEQ ID NO: 8712 - DNA, 20 bp, Artificial Sequence
  Description of Artificial Sequence: Synthetic oligonucleotide
  Target: AGXT; (-) strand; PAM type: NRG; PAM sequence: AGG
ttggggttcttgaggcatga

SEQ ID NO: 8713 - DNA, 20 bp, Artificial Sequence
  Description of Artificial Sequence: Synthetic oligonucleotide
  Target: AGXT; (-) strand; PAM type: NRG; PAM sequence: AAG
gttggggttcttgaggcatg

SEQ ID NO: 8714 - DNA, 20 bp, Artificial Sequence
  Description of Artificial Sequence: Synthetic oligonucleotide
  Target: AGXT; (-) strand; PAM type: NRG; PAM sequence: AGG
ggctctagttggggttcttg

SEQ ID NO: 8715 - DNA, 20 bp, Artificial Sequence
  Description of Artificial Sequence: Synthetic oligonucleotide
  Target: AGXT; (-) strand; PAM type: NRG; PAM sequence: GAG
gggctctagttggggttctt

SEQ ID NO: 8716 - DNA, 20 bp, Artificial Sequence
  Description of Artificial Sequence: Synthetic oligonucleotide
  Target: AGXT; (-) strand; PAM type: NRG; PAM sequence: GGG
ggattctggggctctagttg

SEQ ID NO: 8717 - DNA, 20 bp, Artificial Sequence
  Description of Artificial Sequence: Synthetic oligonucleotide
  Target: AGXT; (-) strand; PAM type: NRG; PAM sequence: GGG
cggattctggggctctagtt

SEQ ID NO: 8718 - DNA, 20 bp, Artificial Sequence
  Description of Artificial Sequence: Synthetic oligonucleotide
  Target: AGXT; (-) strand; PAM type: NRG; PAM sequence: TGG
gcggattctggggctctagt

SEQ ID NO: 8719 - DNA, 20 bp, Artificial Sequence
  Description of Artificial Sequence: Synthetic oligonucleotide
  Target: AGXT; (-) strand; PAM type: NRG; PAM sequence: TAG
gcaggcggattctggggctc

SEQ ID NO: 8720 - DNA, 20 bp, Artificial Sequence
  Description of Artificial Sequence: Synthetic oligonucleotide
  Target: AGXT; (-) strand; PAM type: NRG; PAM sequence: GGG
cctgatgcaggcggattctg

SEQ ID NO: 8721 - DNA, 20 bp, Artificial Sequence
  Description of Artificial Sequence: Synthetic oligonucleotide
  Target: AGXT; (-) strand; PAM type: NRG; PAM sequence: GGG
gcctgatgcaggcggattct

SEQ ID NO: 8722 - DNA, 20 bp, Artificial Sequence
  Description of Artificial Sequence: Synthetic oligonucleotide
  Target: AGXT; (-) strand; PAM type: NRG; PAM sequence: TGG
tgcctgatgcaggcggattc

SEQ ID NO: 8723 - DNA, 20 bp, Artificial Sequence
  Description of Artificial Sequence: Synthetic oligonucleotide
  Target: AGXT; (-) strand; PAM type: NRG; PAM sequence: CGG
atttgactgcctgatgcagg

SEQ ID NO: 8724 - DNA, 20 bp, Artificial Sequence
  Description of Artificial Sequence: Synthetic oligonucleotide
  Target: AGXT; (-) strand; PAM type: NRG; PAM sequence: AGG
ggcatttgactgcctgatgc

SEQ ID NO: 8725 - DNA, 20 bp, Artificial Sequence
  Description of Artificial Sequence: Synthetic oligonucleotide
  Target: AGXT; (-) strand; PAM type: NRG; PAM sequence: CAG
gggcatttgactgcctgatg

SEQ ID NO: 8726 - DNA, 20 bp, Artificial Sequence
  Description of Artificial Sequence: Synthetic oligonucleotide
  Target: AGXT; (-) strand; PAM type: NRG; PAM sequence: GGG
gaatgggggaacccagggtg

SEQ ID NO: 8727 - DNA, 20 bp, Artificial Sequence
  Description of Artificial Sequence: Synthetic oligonucleotide
  Target: AGXT; (-) strand; PAM type: NRG; PAM sequence: GGG
ggaatgggggaacccagggt

SEQ ID NO: 8728 - DNA, 20 bp, Artificial Sequence
  Description of Artificial Sequence: Synthetic oligonucleotide
  Target: AGXT; (-) strand; PAM type: NRG; PAM sequence: TGG
aggaatgggggaacccaggg

SEQ ID NO: 8729 - DNA, 20 bp, Artificial Sequence
  Description of Artificial Sequence: Synthetic oligonucleotide
  Target: AGXT; (-) strand; PAM type: NRG; PAM sequence: GGG
tcgaggaatgggggaaccca

SEQ ID NO: 8730 - DNA, 20 bp, Artificial Sequence
  Description of Artificial Sequence: Synthetic oligonucleotide
  Target: AGXT; (-) strand; PAM type: NRG; PAM sequence: AGG
gtcgaggaatgggggaaccc

SEQ ID NO: 8731 - DNA, 20 bp, Artificial Sequence
  Description of Artificial Sequence: Synthetic oligonucleotide
  Target: AGXT; (-) strand; PAM type: NRG; PAM sequence: CAG
agtcgaggaatgggggaacc

SEQ ID NO: 8732 - DNA, 20 bp, Artificial Sequence
  Description of Artificial Sequence: Synthetic oligonucleotide
  Target: AGXT; (-) strand; PAM type: NRG; PAM sequence: GGG
tcgggccagtcgaggaatgg

SEQ ID NO: 8733 - DNA, 20 bp, Artificial Sequence
  Description of Artificial Sequence: Synthetic oligonucleotide
  Target: AGXT; (-) strand; PAM type: NRG; PAM sequence: GGG
ctcgggccagtcgaggaatg

SEQ ID NO: 8734 - DNA, 20 bp, Artificial Sequence
  Description of Artificial Sequence: Synthetic oligonucleotide
  Target: AGXT; (-) strand; PAM type: NRG; PAM sequence: GGG
cctcgggccagtcgaggaat

SEQ ID NO: 8735 - DNA, 20 bp, Artificial Sequence
  Description of Artificial Sequence: Synthetic oligonucleotide
  Target: AGXT; (-) strand; PAM type: NRG; PAM sequence: TGG
gcctcgggccagtcgaggaa

SEQ ID NO: 8736 - DNA, 20 bp, Artificial Sequence
  Description of Artificial Sequence: Synthetic oligonucleotide
  Target: AGXT; (-) strand; PAM type: NRG; PAM sequence: AGG
ccagagcctcgggccagtcg

SEQ ID NO: 8737 - DNA, 20 bp, Artificial Sequence
  Description of Artificial Sequence: Synthetic oligonucleotide
  Target: AGXT; (-) strand; PAM type: NRG; PAM sequence: GAG
cccagagcctcgggccagtc

SEQ ID NO: 8738 - DNA, 20 bp, Artificial Sequence
  Description of Artificial Sequence: Synthetic oligonucleotide
  Target: AGXT; (-) strand; PAM type: NRG; PAM sequence: CAG
ccctgcccagagcctcgggc

SEQ ID NO: 8739 - DNA, 20 bp, Artificial Sequence
  Description of Artificial Sequence: Synthetic oligonucleotide
  Target: AGXT; (-) strand; PAM type: NRG; PAM sequence: GGG
atgaccctgcccagagcctc

SEQ ID NO: 8740 - DNA, 20 bp, Artificial Sequence
  Description of Artificial Sequence: Synthetic oligonucleotide
  Target: AGXT; (-) strand; PAM type: NRG; PAM sequence: CGG
catgaccctgcccagagcct

SEQ ID NO: 8741 - DNA, 20 bp, Artificial Sequence
  Description of Artificial Sequence: Synthetic oligonucleotide
  Target: AGXT; (-) strand; PAM type: NRG; PAM sequence: GAG
gggggccatgaccctgccca

SEQ ID NO: 8742 - DNA, 20 bp, Artificial Sequence
  Description of Artificial Sequence: Synthetic oligonucleotide
  Target: AGXT; (-) strand; PAM type: NRG; PAM sequence: CAG
gtgggggccatgaccctgcc

SEQ ID NO: 8743 - DNA, 20 bp, Artificial Sequence
  Description of Artificial Sequence: Synthetic oligonucleotide
  Target: AGXT; (-) strand; PAM type: NRG; PAM sequence: GGG
gtttgtggaagcggcagtgg

SEQ ID NO: 8744 - DNA, 20 bp, Artificial Sequence
  Description of Artificial Sequence: Synthetic oligonucleotide
  Target: AGXT; (-) strand; PAM type: NRG; PAM sequence: GGG
tgtttgtggaagcggcagtg

SEQ ID NO: 8745 - DNA, 20 bp, Artificial Sequence
  Description of Artificial Sequence: Synthetic oligonucleotide
  Target: AGXT; (-) strand; PAM type: NRG; PAM sequence: GGG
gtgtttgtggaagcggcagt

SEQ ID NO: 8746 - DNA, 20 bp, Artificial Sequence
  Description of Artificial Sequence: Synthetic oligonucleotide
  Target: AGXT; (-) strand; PAM type: NRG; PAM sequence: TGG
agtgtttgtggaagcggcag

SEQ ID NO: 8747 - DNA, 20 bp, Artificial Sequence
  Description of Artificial Sequence: Synthetic oligonucleotide
  Target: AGXT; (-) strand; PAM type: NRG; PAM sequence: CAG
gacagtgtttgtggaagcgg

SEQ ID NO: 8748 - DNA, 20 bp, Artificial Sequence
  Description of Artificial Sequence: Synthetic oligonucleotide
  Target: AGXT; (-) strand; PAM type: NRG; PAM sequence: CGG
ggggacagtgtttgtggaag

SEQ ID NO: 8749 - DNA, 20 bp, Artificial Sequence
  Description of Artificial Sequence: Synthetic oligonucleotide
  Target: AGXT; (-) strand; PAM type: NRG; PAM sequence: AAG
tggggggacagtgtttgtgg

SEQ ID NO: 8750 - DNA, 20 bp, Artificial Sequence
  Description of Artificial Sequence: Synthetic oligonucleotide
  Target: AGXT; (-) strand; PAM type: NRG; PAM sequence: TGG
ctctggggggacagtgtttg

SEQ ID NO: 8751 - DNA, 20 bp, Artificial Sequence
  Description of Artificial Sequence: Synthetic oligonucleotide
  Target: AGXT; (-) strand; PAM type: NRG; PAM sequence: CAG
tgctgggacctctgggggga

SEQ ID NO: 8752 - DNA, 20 bp, Artificial Sequence
  Description of Artificial Sequence: Synthetic oligonucleotide
  Target: AGXT; (-) strand; PAM type: NRG; PAM sequence: GGG
ggtgtgctgggacctctggg

SEQ ID NO: 8753 - DNA, 20 bp, Artificial Sequence
  Description of Artificial Sequence: Synthetic oligonucleotide
  Target: AGXT; (-) strand; PAM type: NRG; PAM sequence: GGG
gggtgtgctgggacctctgg

SEQ ID NO: 8754 - DNA, 20 bp, Artificial Sequence
  Description of Artificial Sequence: Synthetic oligonucleotide
  Target: AGXT; (-) strand; PAM type: NRG; PAM sequence: GGG
agggtgtgctgggacctctg

SEQ ID NO: 8755 - DNA, 20 bp, Artificial Sequence
  Description of Artificial Sequence: Synthetic oligonucleotide
  Target: AGXT; (-) strand; PAM type: NRG; PAM sequence: GGG
gagggtgtgctgggacctct

SEQ ID NO: 8756 - DNA, 20 bp, Artificial Sequence
  Description of Artificial Sequence: Synthetic oligonucleotide
  Target: AGXT; (-) strand; PAM type: NRG; PAM sequence: TGG
cgagggtgtgctgggacctc

SEQ ID NO: 8757 - DNA, 20 bp, Artificial Sequence
  Description of Artificial Sequence: Synthetic oligonucleotide
  Target: AGXT; (-) strand; PAM type: NRG; PAM sequence: GGG
aaagtgcccgagggtgtgct

SEQ ID NO: 8758 - DNA, 20 bp, Artificial Sequence
  Description of Artificial Sequence: Synthetic oligonucleotide
  Target: AGXT; (-) strand; PAM type: NRG; PAM sequence: TGG
caaagtgcccgagggtgtgc

SEQ ID NO: 8759 - DNA, 20 bp, Artificial Sequence
  Description of Artificial Sequence: Synthetic oligonucleotide
  Target: AGXT; (-) strand; PAM type: NRG; PAM sequence: GGG
gccaggtccaaagtgcccga

SEQ ID NO: 8760 - DNA, 20 bp, Artificial Sequence
  Description of Artificial Sequence: Synthetic oligonucleotide
  Target: AGXT; (-) strand; PAM type: NRG; PAM sequence: AGG
ggccaggtccaaagtgcccg

SEQ ID NO: 8761 - DNA, 20 bp, Artificial Sequence
  Description of Artificial Sequence: Synthetic oligonucleotide
  Target: AGXT; (-) strand; PAM type: NRG; PAM sequence: GAG
gggccaggtccaaagtgccc

SEQ ID NO: 8762 - DNA, 20 bp, Artificial Sequence
  Description of Artificial Sequence: Synthetic oligonucleotide
  Target: AGXT; (-) strand; PAM type: NRG; PAM sequence: AAG
atgtggcagggccaggtcca

SEQ ID NO: 8763 - DNA, 20 bp, Artificial Sequence
  Description of Artificial Sequence: Synthetic oligonucleotide
  Target: AGXT; (-) strand; PAM type: NRG; PAM sequence: AGG
tggggagatgtggcagggcc

SEQ ID NO: 8764 - DNA, 20 bp, Artificial Sequence
  Description of Artificial Sequence: Synthetic oligonucleotide
  Target: AGXT; (-) strand; PAM type: NRG; PAM sequence: CAG
gtggggagatgtggcagggc

SEQ ID NO: 8765 - DNA, 20 bp, Artificial Sequence
  Description of Artificial Sequence: Synthetic oligonucleotide
  Target: AGXT; (-) strand; PAM type: NRG; PAM sequence: GGG
aggagtggggagatgtggca

SEQ ID NO: 8766 - DNA, 20 bp, Artificial Sequence
  Description of Artificial Sequence: Synthetic oligonucleotide
  Target: AGXT; (-) strand; PAM type: NRG; PAM sequence: AGG
caggagtggggagatgtggc

SEQ ID NO: 8767 - DNA, 20 bp, Artificial Sequence
  Description of Artificial Sequence: Synthetic oligonucleotide
  Target: AGXT; (-) strand; PAM type: NRG; PAM sequence: CAG
ccaggagtggggagatgtgg

SEQ ID NO: 8768 - DNA, 20 bp, Artificial Sequence
  Description of Artificial Sequence: Synthetic oligonucleotide
  Target: AGXT; (-) strand; PAM type: NRG; PAM sequence: TGG
ggcccaggagtggggagatg

SEQ ID NO: 8769 - DNA, 20 bp, Artificial Sequence
  Description of Artificial Sequence: Synthetic oligonucleotide
  Target: AGXT; (-) strand; PAM type: NRG; PAM sequence: GAG
agctgaggcccaggagtggg

SEQ ID NO: 8770 - DNA, 20 bp, Artificial Sequence
  Description of Artificial Sequence: Synthetic oligonucleotide
  Target: AGXT; (-) strand; PAM type: NRG; PAM sequence: GGG
taagctgaggcccaggagtg

SEQ ID NO: 8771 - DNA, 20 bp, Artificial Sequence
  Description of Artificial Sequence: Synthetic oligonucleotide
  Target: AGXT; (-) strand; PAM type: NRG; PAM sequence: GGG
gtaagctgaggcccaggagt

SEQ ID NO: 8772 - DNA, 20 bp, Artificial Sequence
  Description of Artificial Sequence: Synthetic oligonucleotide
  Target: AGXT; (-) strand; PAM type: NRG; PAM sequence: TGG
ggtaagctgaggcccaggag

SEQ ID NO: 8773 - DNA, 20 bp, Artificial Sequence
  Description of Artificial Sequence: Synthetic oligonucleotide
  Target: AGXT; (-) strand; PAM type: NRG; PAM sequence: GAG
aggggtaagctgaggcccag

SEQ ID NO: 8774 - DNA, 20 bp, Artificial Sequence
  Description of Artificial Sequence: Synthetic oligonucleotide
  Target: AGXT; (-) strand; PAM type: NRG; PAM sequence: AGG
gaaggggtaagctgaggccc

SEQ ID NO: 8775 - DNA, 20 bp, Artificial Sequence
  Description of Artificial Sequence: Synthetic oligonucleotide
  Target: AGXT; (-) strand; PAM type: NRG; PAM sequence: CAG
agaaggggtaagctgaggcc

SEQ ID NO: 8776 - DNA, 20 bp, Artificial Sequence
  Description of Artificial Sequence: Synthetic oligonucleotide
  Target: AGXT; (-) strand; PAM type: NRG; PAM sequence: AGG
ttttcagaaggggtaagctg

SEQ ID NO: 8777 - DNA, 20 bp, Artificial Sequence
  Description of Artificial Sequence: Synthetic oligonucleotide
  Target: AGXT; (-) strand; PAM type: NRG; PAM sequence: GAG
cttttcagaaggggtaagct

SEQ ID NO: 8778 - DNA, 20 bp, Artificial Sequence
  Description of Artificial Sequence: Synthetic oligonucleotide
  Target: AGXT; (-) strand; PAM type: NRG; PAM sequence: AAG
gtcgtcttttcagaaggggt

SEQ ID NO: 8779 - DNA, 20 bp, Artificial Sequence
  Description of Artificial Sequence: Synthetic oligonucleotide
  Target: AGXT; (-) strand; PAM type: NRG; PAM sequence: GGG
caaggtcgtcttttcagaag

SEQ ID NO: 8780 - DNA, 20 bp, Artificial Sequence
  Description of Artificial Sequence: Synthetic oligonucleotide
  Target: AGXT; (-) strand; PAM type: NRG; PAM sequence: GGG
ccaaggtcgtcttttcagaa

SEQ ID NO: 8781 - DNA, 20 bp, Artificial Sequence
  Description of Artificial Sequence: Synthetic oligonucleotide
  Target: AGXT; (-) strand; PAM type: NRG; PAM sequence: AGG
gccaaggtcgtcttttcaga

SEQ ID NO: 8782 - DNA, 20 bp, Artificial Sequence
  Description of Artificial Sequence: Synthetic oligonucleotide
  Target: AGXT; (-) strand; PAM type: NRG; PAM sequence: AAG
ggccaaggtcgtcttttcag

SEQ ID NO: 8783 - DNA, 20 bp, Artificial Sequence
  Description of Artificial Sequence: Synthetic oligonucleotide
  Target: AGXT; (-) strand; PAM type: NRG; PAM sequence: CAG
tatggccaaggtcgtctttt

SEQ ID NO: 8784 - DNA, 20 bp, Artificial Sequence
  Description of Artificial Sequence: Synthetic oligonucleotide
  Target: AGXT; (-) strand; PAM type: NRG; PAM sequence: AGG
gggccttgggtttatggcca

SEQ ID NO: 8785 - DNA, 20 bp, Artificial Sequence
  Description of Artificial Sequence: Synthetic oligonucleotide
  Target: AGXT; (-) strand; PAM type: NRG; PAM sequence: AAG
ggggccttgggtttatggcc

SEQ ID NO: 8786 - DNA, 20 bp, Artificial Sequence
  Description of Artificial Sequence: Synthetic oligonucleotide
  Target: AGXT; (-) strand; PAM type: NRG; PAM sequence: TGG
cataaggggccttgggttta

SEQ ID NO: 8787 - DNA, 20 bp, Artificial Sequence
  Description of Artificial Sequence: Synthetic oligonucleotide
  Target: AGXT; (-) strand; PAM type: NRG; PAM sequence: GGG
tgtgtaacataaggggcctt

SEQ ID NO: 8788 - DNA, 20 bp, Artificial Sequence
  Description of Artificial Sequence: Synthetic oligonucleotide
  Target: AGXT; (-) strand; PAM type: NRG; PAM sequence: TGG
gtgtgtaacataaggggcct

SEQ ID NO: 8789 - DNA, 20 bp, Artificial Sequence
  Description of Artificial Sequence: Synthetic oligonucleotide
  Target: AGXT; (-) strand; PAM type: NRG; PAM sequence: GGG
gttcctgtgtgtaacataag

SEQ ID NO: 8790 - DNA, 20 bp, Artificial Sequence
  Description of Artificial Sequence: Synthetic oligonucleotide
  Target: AGXT; (-) strand; PAM type: NRG; PAM sequence: GGG
tgttcctgtgtgtaacataa

SEQ ID NO: 8791 - DNA, 20 bp, Artificial Sequence
  Description of Artificial Sequence: Synthetic oligonucleotide
  Target: AGXT; (-) strand; PAM type: NRG; PAM sequence: AGG
ttgttcctgtgtgtaacata

SEQ ID NO: 8792 - DNA, 20 bp, Artificial Sequence
  Description of Artificial Sequence: Synthetic oligonucleotide
  Target: AGXT; (-) strand; PAM type: NRG; PAM sequence: AAG
cttgttcctgtgtgtaacat

SEQ ID NO: 8793 - DNA, 20 bp, Artificial Sequence
  Description of Artificial Sequence: Synthetic oligonucleotide
  Target: AGXT; (-) strand; PAM type: NRG; PAM sequence: TGG
ctgggctagggcaccattcc

SEQ ID NO: 8794 - DNA, 20 bp, Artificial Sequence
  Description of Artificial Sequence: Synthetic oligonucleotide
  Target: AGXT; (-) strand; PAM type: NRG; PAM sequence: GGG
cctctgtgcccactgggcta

SEQ ID NO: 8795 - DNA, 20 bp, Artificial Sequence
  Description of Artificial Sequence: Synthetic oligonucleotide
  Target: AGXT; (-) strand; PAM type: NRG; PAM sequence: AGG
ccctctgtgcccactgggct

SEQ ID NO: 8796 - DNA, 20 bp, Artificial Sequence
  Description of Artificial Sequence: Synthetic oligonucleotide
  Target: AGXT; (-) strand; PAM type: NRG; PAM sequence: TAG
gccctctgtgcccactgggc

SEQ ID NO: 8797 - DNA, 20 bp, Artificial Sequence
  Description of Artificial Sequence: Synthetic oligonucleotide
  Target: AGXT; (-) strand; PAM type: NRG; PAM sequence: GGG
actggccctctgtgcccact

SEQ ID NO: 8798 - DNA, 20 bp, Artificial Sequence
  Description of Artificial Sequence: Synthetic oligonucleotide
  Target: AGXT; (-) strand; PAM type: NRG; PAM sequence: TGG
cactggccctctgtgcccac

SEQ ID NO: 8799 - DNA, 20 bp, Artificial Sequence
  Description of Artificial Sequence: Synthetic oligonucleotide
  Target: AGXT; (-) strand; PAM type: NRG; PAM sequence: TGG
cgtgcctgcgaagccggcac

SEQ ID NO: 8800 - DNA, 20 bp, Artificial Sequence
  Description of Artificial Sequence: Synthetic oligonucleotide
  Target: AGXT; (-) strand; PAM type: NRG; PAM sequence: CGG
tcccagcgtgcctgcgaagc

SEQ ID NO: 8801 - DNA, 20 bp, Artificial Sequence
  Description of Artificial Sequence: Synthetic oligonucleotide
  Target: AGXT; (-) strand; PAM type: NRG; PAM sequence: AAG
tcagtcccagcgtgcctgcg

SEQ ID NO: 8802 - DNA, 20 bp, Artificial Sequence
  Description of Artificial Sequence: Synthetic oligonucleotide
  Target: AGXT; (-) strand; PAM type: NRG; PAM sequence: CAG
cctgcggagcccctcagtcc

SEQ ID NO: 8803 - DNA, 20 bp, Artificial Sequence
  Description of Artificial Sequence: Synthetic oligonucleotide
  Target: AGXT; (-) strand; PAM type: NRG; PAM sequence: CAG
cacctccctgcggagcccct

SEQ ID NO: 8804 - DNA, 20 bp, Artificial Sequence
  Description of Artificial Sequence: Synthetic oligonucleotide
  Target: AGXT; (-) strand; PAM type: NRG; PAM sequence: GAG
cgtgccaccacctccctgcg

SEQ ID NO: 8805 - DNA, 20 bp, Artificial Sequence
  Description of Artificial Sequence: Synthetic oligonucleotide
  Target: AGXT; (-) strand; PAM type: NRG; PAM sequence: CGG
cacgtgccaccacctccctg

SEQ ID NO: 8806 - DNA, 20 bp, Artificial Sequence
  Description of Artificial Sequence: Synthetic oligonucleotide
  Target: AGXT; (-) strand; PAM type: NRG; PAM sequence: GAG
agtgggtggctgcaggagca

SEQ ID NO: 8807 - DNA, 20 bp, Artificial Sequence
  Description of Artificial Sequence: Synthetic oligonucleotide
  Target: AGXT; (-) strand; PAM type: NRG; PAM sequence: CAG
gcagtgggtggctgcaggag

SEQ ID NO: 8808 - DNA, 20 bp, Artificial Sequence
  Description of Artificial Sequence: Synthetic oligonucleotide
  Target: AGXT; (-) strand; PAM type: NRG; PAM sequence: GAG
gaggcagtgggtggctgcag

SEQ ID NO: 8809 - DNA, 20 bp, Artificial Sequence
  Description of Artificial Sequence: Synthetic oligonucleotide
  Target: AGXT; (-) strand; PAM type: NRG; PAM sequence: AGG
aggaggcagtgggtggctgc

SEQ ID NO: 8810 - DNA, 20 bp, Artificial Sequence
  Description of Artificial Sequence: Synthetic oligonucleotide
  Target: AGXT; (-) strand; PAM type: NRG; PAM sequence: CAG
caggaggcagtgggtggctg

SEQ ID NO: 8811 - DNA, 20 bp, Artificial Sequence
  Description of Artificial Sequence: Synthetic oligonucleotide
  Target: AGXT; (-) strand; PAM type: NRG; PAM sequence: TGG
cccagccaggaggcagtggg

SEQ ID NO: 8812 - DNA, 20 bp, Artificial Sequence
  Description of Artificial Sequence: Synthetic oligonucleotide
  Target: AGXT; (-) strand; PAM type: NRG; PAM sequence: GGG
gggcccagccaggaggcagt

SEQ ID NO: 8813 - DNA, 20 bp, Artificial Sequence
  Description of Artificial Sequence: Synthetic oligonucleotide
  Target: AGXT; (-) strand; PAM type: NRG; PAM sequence: TGG
agggcccagccaggaggcag

SEQ ID NO: 8814 - DNA, 20 bp, Artificial Sequence
  Description of Artificial Sequence: Synthetic oligonucleotide
  Target: AGXT; (-) strand; PAM type: NRG; PAM sequence: CAG
tgtagggcccagccaggagg

SEQ ID NO: 8815 - DNA, 20 bp, Artificial Sequence
  Description of Artificial Sequence: Synthetic oligonucleotide
  Target: AGXT; (-) strand; PAM type: NRG; PAM sequence: AGG
ttgtgtagggcccagccagg

SEQ ID NO: 8816 - DNA, 20 bp, Artificial Sequence
  Description of Artificial Sequence: Synthetic oligonucleotide
  Target: AGXT; (-) strand; PAM type: NRG; PAM sequence: GAG
cttgtgtagggcccagccag

SEQ ID NO: 8817 - DNA, 20 bp, Artificial Sequence
  Description of Artificial Sequence: Synthetic oligonucleotide
  Target: AGXT; (-) strand; PAM type: NRG; PAM sequence: AGG
ggcttgtgtagggcccagcc

SEQ ID NO: 8818 - DNA, 20 bp, Artificial Sequence
  Description of Artificial Sequence: Synthetic oligonucleotide
  Target: AGXT; (-) strand; PAM type: NRG; PAM sequence: CAG
tggcttgtgtagggcccagc

SEQ ID NO: 8819 - DNA, 20 bp, Artificial Sequence
  Description of Artificial Sequence: Synthetic oligonucleotide
  Target: AGXT; (-) strand; PAM type: NRG; PAM sequence: CAG
agcatggcttgtgtagggcc

SEQ ID NO: 8820 - DNA, 20 bp, Artificial Sequence
  Description of Artificial Sequence: Synthetic oligonucleotide
  Target: AGXT; (-) strand; PAM type: NRG; PAM sequence: GGG
gggagagcatggcttgtgta

SEQ ID NO: 8821 - DNA, 20 bp, Artificial Sequence
  Description of Artificial Sequence: Synthetic oligonucleotide
  Target: AGXT; (-) strand; PAM type: NRG; PAM sequence: AGG
agggagagcatggcttgtgt

SEQ ID NO: 8822 - DNA, 20 bp, Artificial Sequence
  Description of Artificial Sequence: Synthetic oligonucleotide
  Target: AGXT; (-) strand; PAM type: NRG; PAM sequence: TAG
cagggagagcatggcttgtg

SEQ ID NO: 8823 - DNA, 20 bp, Artificial Sequence
  Description of Artificial Sequence: Synthetic oligonucleotide
  Target: AGXT; (-) strand; PAM type: NRG; PAM sequence: TGG
ttcgtctgccagggagagca

SEQ ID NO: 8824 - DNA, 20 bp, Artificial Sequence
  Description of Artificial Sequence: Synthetic oligonucleotide
  Target: AGXT; (-) strand; PAM type: NRG; PAM sequence: GAG
gcagcttcgtctgccaggga

SEQ ID NO: 8825 - DNA, 20 bp, Artificial Sequence
  Description of Artificial Sequence: Synthetic oligonucleotide
  Target: AGXT; (-) strand; PAM type: NRG; PAM sequence: GAG
aggcagcttcgtctgccagg

SEQ ID NO: 8826 - DNA, 20 bp, Artificial Sequence
  Description of Artificial Sequence: Synthetic oligonucleotide
  Target: AGXT; (-) strand; PAM type: NRG; PAM sequence: GGG
gaaggcagcttcgtctgcca

SEQ ID NO: 8827 - DNA, 20 bp, Artificial Sequence
  Description of Artificial Sequence: Synthetic oligonucleotide
  Target: AGXT; (-) strand; PAM type: NRG; PAM sequence: AGG
ggaaggcagcttcgtctgcc

SEQ ID NO: 8828 - DNA, 20 bp, Artificial Sequence
  Description of Artificial Sequence: Synthetic oligonucleotide
  Target: AGXT; (-) strand; PAM type: NRG; PAM sequence: CAG
gggaaggcagcttcgtctgc

SEQ ID NO: 8829 - DNA, 20 bp, Artificial Sequence
  Description of Artificial Sequence: Synthetic oligonucleotide
  Target: AGXT; (-) strand; PAM type: NRG; PAM sequence: CAG
agaactttggaccgggaagg

SEQ ID NO: 8830 - DNA, 20 bp, Artificial Sequence
  Description of Artificial Sequence: Synthetic oligonucleotide
  Target: AGXT; (-) strand; PAM type: NRG; PAM sequence: AGG
ttcagaactttggaccggga

SEQ ID NO: 8831 - DNA, 20 bp, Artificial Sequence
  Description of Artificial Sequence: Synthetic oligonucleotide
  Target: AGXT; (-) strand; PAM type: NRG; PAM sequence: AAG
gttcagaactttggaccggg

SEQ ID NO: 8832 - DNA, 20 bp, Artificial Sequence
  Description of Artificial Sequence: Synthetic oligonucleotide
  Target: AGXT; (-) strand; PAM type: NRG; PAM sequence: GGG
cgggttcagaactttggacc

SEQ ID NO: 8833 - DNA, 20 bp, Artificial Sequence
  Description of Artificial Sequence: Synthetic oligonucleotide
  Target: AGXT; (-) strand; PAM type: NRG; PAM sequence: CGG
ccgggttcagaactttggac

SEQ ID NO: 8834 - DNA, 20 bp, Artificial Sequence
  Description of Artificial Sequence: Synthetic oligonucleotide
  Target: AGXT; (-) strand; PAM type: NRG; PAM sequence: TGG
cctgtccgggttcagaactt

SEQ ID NO: 8835 - DNA, 20 bp, Artificial Sequence
  Description of Artificial Sequence: Synthetic oligonucleotide
  Target: AGXT; (-) strand; PAM type: NRG; PAM sequence: CAG
agaggagtcctgtccgggtt

SEQ ID NO: 8836 - DNA, 20 bp, Artificial Sequence
  Description of Artificial Sequence: Synthetic oligonucleotide
  Target: AGXT; (-) strand; PAM type: NRG; PAM sequence: GGG
tccgcagaggagtcctgtcc

SEQ ID NO: 8837 - DNA, 20 bp, Artificial Sequence
  Description of Artificial Sequence: Synthetic oligonucleotide
  Target: AGXT; (-) strand; PAM type: NRG; PAM sequence: CGG
ctccgcagaggagtcctgtc

SEQ ID NO: 8838 - DNA, 20 bp, Artificial Sequence
  Description of Artificial Sequence: Synthetic oligonucleotide
  Target: AGXT; (-) strand; PAM type: NRG; PAM sequence: GAG
ggccggtatcctccgcagag

SEQ ID NO: 8839 - DNA, 20 bp, Artificial Sequence
  Description of Artificial Sequence: Synthetic oligonucleotide
  Target: AGXT; (-) strand; PAM type: NRG; PAM sequence: AGG
caggccggtatcctccgcag

SEQ ID NO: 8840 - DNA, 20 bp, Artificial Sequence
  Description of Artificial Sequence: Synthetic oligonucleotide
  Target: AGXT; (-) strand; PAM type: NRG; PAM sequence: GAG
acaggccggtatcctccgca

SEQ ID NO: 8841 - DNA, 20 bp, Artificial Sequence
  Description of Artificial Sequence: Synthetic oligonucleotide
  Target: AGXT; (-) strand; PAM type: NRG; PAM sequence: CAG
ccacaggccggtatcctccg

SEQ ID NO: 8842 - DNA, 20 bp, Artificial Sequence
  Description of Artificial Sequence: Synthetic oligonucleotide
  Target: AGXT; (-) strand; PAM type: NRG; PAM sequence: CGG
caggctctctgaccacaggc

SEQ ID NO: 8843 - DNA, 20 bp, Artificial Sequence
  Description of Artificial Sequence: Synthetic oligonucleotide
  Target: AGXT; (-) strand; PAM type: NRG; PAM sequence: AGG
agcacaggctctctgaccac

SEQ ID NO: 8844 - DNA, 20 bp, Artificial Sequence
  Description of Artificial Sequence: Synthetic oligonucleotide
  Target: AGXT; (-) strand; PAM type: NRG; PAM sequence: CAG
cagcacaggctctctgacca

SEQ ID NO: 8845 - DNA, 20 bp, Artificial Sequence
  Description of Artificial Sequence: Synthetic oligonucleotide
  Target: AGXT; (-) strand; PAM type: NRG; PAM sequence: AGG
tgccccagccccaacagcac

SEQ ID NO: 8846 - DNA, 20 bp, Artificial Sequence
  Description of Artificial Sequence: Synthetic oligonucleotide
  Target: AGXT; (-) strand; PAM type: NRG; PAM sequence: CAG
ctgccccagccccaacagca

SEQ ID NO: 8847 - DNA, 20 bp, Artificial Sequence
  Description of Artificial Sequence: Synthetic oligonucleotide
  Target: AGXT; (-) strand; PAM type: NRG; PAM sequence: CAG
tctgtctgccccagccccaa

SEQ ID NO: 8848 - DNA, 20 bp, Artificial Sequence
  Description of Artificial Sequence: Synthetic oligonucleotide
  Target: AGXT; (-) strand; PAM type: NRG; PAM sequence: CAG
ggcattagctctgtctgccc

SEQ ID NO: 8849 - DNA, 20 bp, Artificial Sequence
  Description of Artificial Sequence: Synthetic oligonucleotide
  Target: AGXT; (-) strand; PAM type: NRG; PAM sequence: TAG
gttgggggcagatggggcat

SEQ ID NO: 8850 - DNA, 20 bp, Artificial Sequence
  Description of Artificial Sequence: Synthetic oligonucleotide
  Target: AGXT; (-) strand; PAM type: NRG; PAM sequence: GGG
ggcagggttgggggcagatg

SEQ ID NO: 8851 - DNA, 20 bp, Artificial Sequence
  Description of Artificial Sequence: Synthetic oligonucleotide
  Target: AGXT; (-) strand; PAM type: NRG; PAM sequence: GGG
gggcagggttgggggcagat

SEQ ID NO: 8852 - DNA, 20 bp, Artificial Sequence
  Description of Artificial Sequence: Synthetic oligonucleotide
  Target: AGXT; (-) strand; PAM type: NRG; PAM sequence: TGG
tgggcagggttgggggcaga

SEQ ID NO: 8853 - DNA, 20 bp, Artificial Sequence
  Description of Artificial Sequence: Synthetic oligonucleotide
  Target: AGXT; (-) strand; PAM type: NRG; PAM sequence: CAG
accatgggcagggttggggg

SEQ ID NO: 8854 - DNA, 20 bp, Artificial Sequence
  Description of Artificial Sequence: Synthetic oligonucleotide
  Target: AGXT; (-) strand; PAM type: NRG; PAM sequence: GGG
agcaccatgggcagggttgg

SEQ ID NO: 8855 - DNA, 20 bp, Artificial Sequence
  Description of Artificial Sequence: Synthetic oligonucleotide
  Target: AGXT; (-) strand; PAM type: NRG; PAM sequence: GGG
cagcaccatgggcagggttg

SEQ ID NO: 8856 - DNA, 20 bp, Artificial Sequence
  Description of Artificial Sequence: Synthetic oligonucleotide
  Target: AGXT; (-) strand; PAM type: NRG; PAM sequence: GGG
ccagcaccatgggcagggtt

SEQ ID NO: 8857 - DNA, 20 bp, Artificial Sequence
  Description of Artificial Sequence: Synthetic oligonucleotide
  Target: AGXT; (-) strand; PAM type: NRG; PAM sequence: TGG
tccagcaccatgggcagggt

SEQ ID NO: 8858 - DNA, 20 bp, Artificial Sequence
  Description of Artificial Sequence: Synthetic oligonucleotide
  Target: AGXT; (-) strand; PAM type: NRG; PAM sequence: GGG
ttggtccagcaccatgggca

SEQ ID NO: 8859 - DNA, 20 bp, Artificial Sequence
  Description of Artificial Sequence: Synthetic oligonucleotide
  Target: AGXT; (-) strand; PAM type: NRG; PAM sequence: AGG
cttggtccagcaccatgggc

SEQ ID NO: 8860 - DNA, 20 bp, Artificial Sequence
  Description of Artificial Sequence: Synthetic oligonucleotide
  Target: AGXT; (-) strand; PAM type: NRG; PAM sequence: CAG
gcttggtccagcaccatggg

SEQ ID NO: 8861 - DNA, 20 bp, Artificial Sequence
  Description of Artificial Sequence: Synthetic oligonucleotide
  Target: AGXT; (-) strand; PAM type: NRG; PAM sequence: GGG
ggggcttggtccagcaccat

SEQ ID NO: 8862 - DNA, 20 bp, Artificial Sequence
  Description of Artificial Sequence: Synthetic oligonucleotide
  Target: AGXT; (-) strand; PAM type: NRG; PAM sequence: TGG
gggggcttggtccagcacca

SEQ ID NO: 8863 - DNA, 20 bp, Artificial Sequence
  Description of Artificial Sequence: Synthetic oligonucleotide
  Target: AGXT; (-) strand; PAM type: NRG; PAM sequence: CAG
agacacgagggggcttggtc

SEQ ID NO: 8864 - DNA, 20 bp, Artificial Sequence
  Description of Artificial Sequence: Synthetic oligonucleotide
  Target: AGXT; (-) strand; PAM type: NRG; PAM sequence: TGG
ctggaagacacgagggggct

SEQ ID NO: 8865 - DNA, 20 bp, Artificial Sequence
  Description of Artificial Sequence: Synthetic oligonucleotide
  Target: AGXT; (-) strand; PAM type: NRG; PAM sequence: GGG
ggtacctggaagacacgagg

SEQ ID NO: 8866 - DNA, 20 bp, Artificial Sequence
  Description of Artificial Sequence: Synthetic oligonucleotide
  Target: AGXT; (-) strand; PAM type: NRG; PAM sequence: GGG
tggtacctggaagacacgag

SEQ ID NO: 8867 - DNA, 20 bp, Artificial Sequence
  Description of Artificial Sequence: Synthetic oligonucleotide
  Target: AGXT; (-) strand; PAM type: NRG; PAM sequence: GGG
atggtacctggaagacacga

SEQ ID NO: 8868 - DNA, 20 bp, Artificial Sequence
  Description of Artificial Sequence: Synthetic oligonucleotide
  Target: AGXT; (-) strand; PAM type: NRG; PAM sequence: AGG
gatggtacctggaagacacg

SEQ ID NO: 8869 - DNA, 20 bp, Artificial Sequence
  Description of Artificial Sequence: Synthetic oligonucleotide
  Target: AGXT; (-) strand; PAM type: NRG; PAM sequence: GAG
tgatggtacctggaagacac

SEQ ID NO: 8870 - DNA, 20 bp, Artificial Sequence
  Description of Artificial Sequence: Synthetic oligonucleotide
  Target: AGXT; (-) strand; PAM type: NRG; PAM sequence: AAG
gattgtgtgatggtacctgg

SEQ ID NO: 8871 - DNA, 20 bp, Artificial Sequence
  Description of Artificial Sequence: Synthetic oligonucleotide
  Target: AGXT; (-) strand; PAM type: NRG; PAM sequence: TGG
ggggattgtgtgatggtacc

SEQ ID NO: 8872 - DNA, 20 bp, Artificial Sequence
  Description of Artificial Sequence: Synthetic oligonucleotide
  Target: AGXT; (-) strand; PAM type: NRG; PAM sequence: TGG
tgatgacggggattgtgtga

SEQ ID NO: 8873 - DNA, 20 bp, Artificial Sequence
  Description of Artificial Sequence: Synthetic oligonucleotide
  Target: AGXT; (-) strand; PAM type: NRG; PAM sequence: GGG
ggctgtacaggctgatgacg

SEQ ID NO: 8874 - DNA, 20 bp, Artificial Sequence
  Description of Artificial Sequence: Synthetic oligonucleotide
  Target: AGXT; (-) strand; PAM type: NRG; PAM sequence: GGG
aggctgtacaggctgatgac

SEQ ID NO: 8875 - DNA, 20 bp, Artificial Sequence
  Description of Artificial Sequence: Synthetic oligonucleotide
  Target: AGXT; (-) strand; PAM type: NRG; PAM sequence: CGG
caggctgtacaggctgatga

SEQ ID NO: 8876 - DNA, 20 bp, Artificial Sequence
  Description of Artificial Sequence: Synthetic oligonucleotide
  Target: AGXT; (-) strand; PAM type: NRG; PAM sequence: AGG
ggctctctctcaggctgtac

SEQ ID NO: 8877 - DNA, 20 bp, Artificial Sequence
  Description of Artificial Sequence: Synthetic oligonucleotide
  Target: AGXT; (-) strand; PAM type: NRG; PAM sequence: CAG
aggctctctctcaggctgta

SEQ ID NO: 8878 - DNA, 20 bp, Artificial Sequence
  Description of Artificial Sequence: Synthetic oligonucleotide
  Target: AGXT; (-) strand; PAM type: NRG; PAM sequence: AGG
tgagggccaggctctctctc

SEQ ID NO: 8879 - DNA, 20 bp, Artificial Sequence
  Description of Artificial Sequence: Synthetic oligonucleotide
  Target: AGXT; (-) strand; PAM type: NRG; PAM sequence: CAG
atgagggccaggctctctct

SEQ ID NO: 8880 - DNA, 20 bp, Artificial Sequence
  Description of Artificial Sequence: Synthetic oligonucleotide
  Target: AGXT; (-) strand; PAM type: NRG; PAM sequence: AGG
cctgttccgcaatgagggcc

SEQ ID NO: 8881 - DNA, 20 bp, Artificial Sequence
  Description of Artificial Sequence: Synthetic oligonucleotide
  Target: AGXT; (-) strand; PAM type: NRG; PAM sequence: CAG
acctgttccgcaatgagggc

SEQ ID NO: 8882 - DNA, 20 bp, Artificial Sequence
  Description of Artificial Sequence: Synthetic oligonucleotide
  Target: AGXT; (-) strand; PAM type: NRG; PAM sequence: GGG
atgcacctgttccgcaatga

SEQ ID NO: 8883 - DNA, 20 bp, Artificial Sequence
  Description of Artificial Sequence: Synthetic oligonucleotide
  Target: AGXT; (-) strand; PAM type: NRG; PAM sequence: AGG
catgcacctgttccgcaatg

SEQ ID NO: 8884 - DNA, 20 bp, Artificial Sequence
  Description of Artificial Sequence: Synthetic oligonucleotide
  Target: AGXT; (-) strand; PAM type: NRG; PAM sequence: GAG
ccatgcacctgttccgcaat

SEQ ID NO: 8885 - DNA, 20 bp, Artificial Sequence
  Description of Artificial Sequence: Synthetic oligonucleotide
  Target: AGXT; (-) strand; PAM type: NRG; PAM sequence: CAG
ctgtctcctcctgtggagtg

SEQ ID NO: 8886 - DNA, 20 bp, Artificial Sequence
  Description of Artificial Sequence: Synthetic oligonucleotide
  Target: AGXT; (-) strand; PAM type: NRG; PAM sequence: GAG
tggccctgtctcctcctgtg

SEQ ID NO: 8887 - DNA, 20 bp, Artificial Sequence
  Description of Artificial Sequence: Synthetic oligonucleotide
  Target: AGXT; (-) strand; PAM type: NRG; PAM sequence: TGG
agtggccctgtctcctcctg

SEQ ID NO: 8888 - DNA, 20 bp, Artificial Sequence
  Description of Artificial Sequence: Synthetic oligonucleotide
  Target: AGXT; (-) strand; PAM type: NRG; PAM sequence: TGG
gccctcgacaatccagccag

SEQ ID NO: 8889 - DNA, 20 bp, Artificial Sequence
  Description of Artificial Sequence: Synthetic oligonucleotide
  Target: AGXT; (-) strand; PAM type: NRG; PAM sequence: CAG
cgcgccctcgacaatccagc

SEQ ID NO: 8890 - DNA, 20 bp, Artificial Sequence
  Description of Artificial Sequence: Synthetic oligonucleotide
  Target: AGXT; (-) strand; PAM type: NRG; PAM sequence: CAG
aggccgcgccctcgacaatc

SEQ ID NO: 8891 - DNA, 20 bp, Artificial Sequence
  Description of Artificial Sequence: Synthetic oligonucleotide
  Target: AGXT; (-) strand; PAM type: NRG; PAM sequence: AGG
agggatggttccttctctgc

SEQ ID NO: 8892 - DNA, 20 bp, Artificial Sequence
  Description of Artificial Sequence: Synthetic oligonucleotide
  Target: AGXT; (-) strand; PAM type: NRG; PAM sequence: CAG
cagggatggttccttctctg

SEQ ID NO: 8893 - DNA, 20 bp, Artificial Sequence
  Description of Artificial Sequence: Synthetic oligonucleotide
  Target: AGXT; (-) strand; PAM type: NRG; PAM sequence: TGG
ttttctctgtgcaccaggga

SEQ ID NO: 8894 - DNA, 20 bp, Artificial Sequence
  Description of Artificial Sequence: Synthetic oligonucleotide
  Target: AGXT; (-) strand; PAM type: NRG; PAM sequence: GGG
tcccttttctctgtgcacca

SEQ ID NO: 8895 - DNA, 20 bp, Artificial Sequence
  Description of Artificial Sequence: Synthetic oligonucleotide
  Target: AGXT; (-) strand; PAM type: NRG; PAM sequence: AGG
ctcccttttctctgtgcacc

SEQ ID NO: 8896 - DNA, 20 bp, Artificial Sequence
  Description of Artificial Sequence: Synthetic oligonucleotide
  Target: AGXT; (-) strand; PAM type: NRG; PAM sequence: CAG
gctcccttttctctgtgcac

SEQ ID NO: 8897 - DNA, 20 bp, Artificial Sequence
  Description of Artificial Sequence: Synthetic oligonucleotide
  Target: AGXT; (-) strand; PAM type: NRG; PAM sequence: AGG
actgagggcctctctctggc

SEQ ID NO: 8898 - DNA, 20 bp, Artificial Sequence
  Description of Artificial Sequence: Synthetic oligonucleotide
  Target: AGXT; (-) strand; PAM type: NRG; PAM sequence: CAG
cactgagggcctctctctgg

SEQ ID NO: 8899 - DNA, 20 bp, Artificial Sequence
  Description of Artificial Sequence: Synthetic oligonucleotide
  Target: AGXT; (-) strand; PAM type: NRG; PAM sequence: TGG
ccccactgagggcctctctc

SEQ ID NO: 8900 - DNA, 20 bp, Artificial Sequence
  Description of Artificial Sequence: Synthetic oligonucleotide
  Target: AGXT; (-) strand; PAM type: NRG; PAM sequence: GGG
ctctcccccacccccactga

SEQ ID NO: 8901 - DNA, 20 bp, Artificial Sequence
  Description of Artificial Sequence: Synthetic oligonucleotide
  Target: AGXT; (-) strand; PAM type: NRG; PAM sequence: AGG
tctctcccccacccccactg

SEQ ID NO: 8902 - DNA, 20 bp, Artificial Sequence
  Description of Artificial Sequence: Synthetic oligonucleotide
  Target: AGXT; (-) strand; PAM type: NRG; PAM sequence: GAG
ctctctcccccacccccact

SEQ ID NO: 8903 - DNA, 20 bp, Artificial Sequence
  Description of Artificial Sequence: Synthetic oligonucleotide
  Target: AGXT; (-) strand; PAM type: NRG; PAM sequence: GGG
gcccgcagccagtgtacccg

SEQ ID NO: 8904 - DNA, 20 bp, Artificial Sequence
  Description of Artificial Sequence: Synthetic oligonucleotide
  Target: AGXT; (-) strand; PAM type: NRG; PAM sequence: GGG
tgcccgcagccagtgtaccc

SEQ ID NO: 8905 - DNA, 20 bp, Artificial Sequence
  Description of Artificial Sequence: Synthetic oligonucleotide
  Target: AGXT; (-) strand; PAM type: NRG; PAM sequence: CGG
ctgcccgcagccagtgtacc

SEQ ID NO: 8906 - DNA, 20 bp, Artificial Sequence
  Description of Artificial Sequence: Synthetic oligonucleotide
  Target: AGXT; (-) strand; PAM type: NRG; PAM sequence: CAG
cccctggccctgcccgcagc

SEQ ID NO: 8907 - DNA, 20 bp, Artificial Sequence
  Description of Artificial Sequence: Synthetic oligonucleotide
  Target: AGXT; (-) strand; PAM type: NRG; PAM sequence: CAG
tatccccctggccctgcccg

SEQ ID NO: 8908 - DNA, 20 bp, Artificial Sequence
  Description of Artificial Sequence: Synthetic oligonucleotide
  Target: AGXT; (-) strand; PAM type: NRG; PAM sequence: TGG
tccctggggctgtatccccc

SEQ ID NO: 8909 - DNA, 20 bp, Artificial Sequence
  Description of Artificial Sequence: Synthetic oligonucleotide
  Target: AGXT; (-) strand; PAM type: NRG; PAM sequence: GGG
cattgctgcatctgtccctg

SEQ ID NO: 8910 - DNA, 20 bp, Artificial Sequence
  Description of Artificial Sequence: Synthetic oligonucleotide
  Target: AGXT; (-) strand; PAM type: NRG; PAM sequence: GGG
ccattgctgcatctgtccct

SEQ ID NO: 8911 - DNA, 20 bp, Artificial Sequence
  Description of Artificial Sequence: Synthetic oligonucleotide
  Target: AGXT; (-) strand; PAM type: NRG; PAM sequence: TGG
cccattgctgcatctgtccc

SEQ ID NO: 8912 - DNA, 20 bp, Artificial Sequence
  Description of Artificial Sequence: Synthetic oligonucleotide
  Target: AGXT; (-) strand; PAM type: NRG; PAM sequence: GAG
cacagcaatggaagggttgg

SEQ ID NO: 8913 - DNA, 20 bp, Artificial Sequence
  Description of Artificial Sequence: Synthetic oligonucleotide
  Target: AGXT; (-) strand; PAM type: NRG; PAM sequence: GGG
cacacagcaatggaagggtt

SEQ ID NO: 8914 - DNA, 20 bp, Artificial Sequence
  Description of Artificial Sequence: Synthetic oligonucleotide
  Target: AGXT; (-) strand; PAM type: NRG; PAM sequence: TGG
tcacacagcaatggaagggt

SEQ ID NO: 8915 - DNA, 20 bp, Artificial Sequence
  Description of Artificial Sequence: Synthetic oligonucleotide
  Target: AGXT; (-) strand; PAM type: NRG; PAM sequence: GGG
tgcttcacacagcaatggaa

SEQ ID NO: 8916 - DNA, 20 bp, Artificial Sequence
  Description of Artificial Sequence: Synthetic oligonucleotide
  Target: AGXT; (-) strand; PAM type: NRG; PAM sequence: AGG
ctgcttcacacagcaatgga

SEQ ID NO: 8917 - DNA, 20 bp, Artificial Sequence
  Description of Artificial Sequence: Synthetic oligonucleotide
  Target: AGXT; (-) strand; PAM type: NRG; PAM sequence: AAG
actgcttcacacagcaatgg

SEQ ID NO: 8918 - DNA, 20 bp, Artificial Sequence
  Description of Artificial Sequence: Synthetic oligonucleotide
  Target: AGXT; (-) strand; PAM type: NRG; PAM sequence: TGG
cttactgcttcacacagcaa

SEQ ID NO: 8919 - DNA, 20 bp, Artificial Sequence
  Description of Artificial Sequence: Synthetic oligonucleotide
  Target: AGXT; (-) strand; PAM type: NRG; PAM sequence: CAG
gcctcacttactgcttcaca

SEQ ID NO: 8920 - DNA, 20 bp, Artificial Sequence
  Description of Artificial Sequence: Synthetic oligonucleotide
  Target: AGXT; (-) strand; PAM type: NRG; PAM sequence: GGG
tcccagcccacccactcact

SEQ ID NO: 8921 - DNA, 20 bp, Artificial Sequence
  Description of Artificial Sequence: Synthetic oligonucleotide
  Target: AGXT; (-) strand; PAM type: NRG; PAM sequence: TGG
ctcccagcccacccactcac

SEQ ID NO: 8922 - DNA, 20 bp, Artificial Sequence
  Description of Artificial Sequence: Synthetic oligonucleotide
  Target: AGXT; (-) strand; PAM type: NRG; PAM sequence: CAG
ccttcggcctccccttctcc

SEQ ID NO: 8923 - DNA, 20 bp, Artificial Sequence
  Description of Artificial Sequence: Synthetic oligonucleotide
  Target: AGXT; (-) strand; PAM type: NRG; PAM sequence: CGG
gggcacatctctggcccctt

SEQ ID NO: 8924 - DNA, 20 bp, Artificial Sequence
  Description of Artificial Sequence: Synthetic oligonucleotide
  Target: AGXT; (-) strand; PAM type: NRG; PAM sequence: TGG
cctatctgtgggcacatctc

SEQ ID NO: 8925 - DNA, 20 bp, Artificial Sequence
  Description of Artificial Sequence: Synthetic oligonucleotide
  Target: AGXT; (-) strand; PAM type: NRG; PAM sequence: GGG
atccacgcccacctatctgt

SEQ ID NO: 8926 - DNA, 20 bp, Artificial Sequence
  Description of Artificial Sequence: Synthetic oligonucleotide
  Target: AGXT; (-) strand; PAM type: NRG; PAM sequence: TGG
catccacgcccacctatctg

SEQ ID NO: 8927 - DNA, 20 bp, Artificial Sequence
  Description of Artificial Sequence: Synthetic oligonucleotide
  Target: AGXT; (-) strand; PAM type: NRG; PAM sequence: AGG
taggagctggacaagcctgc

SEQ ID NO: 8928 - DNA, 20 bp, Artificial Sequence
  Description of Artificial Sequence: Synthetic oligonucleotide
  Target: AGXT; (-) strand; PAM type: NRG; PAM sequence: CAG
ataggagctggacaagcctg

SEQ ID NO: 8929 - DNA, 20 bp, Artificial Sequence
  Description of Artificial Sequence: Synthetic oligonucleotide
  Target: AGXT; (-) strand; PAM type: NRG; PAM sequence: AAG
ccctgccataggagctggac

SEQ ID NO: 8930 - DNA, 20 bp, Artificial Sequence
  Description of Artificial Sequence: Synthetic oligonucleotide
  Target: AGXT; (-) strand; PAM type: NRG; PAM sequence: TGG
tcttgccctgccataggagc

SEQ ID NO: 8931 - DNA, 20 bp, Artificial Sequence
  Description of Artificial Sequence: Synthetic oligonucleotide
  Target: AGXT; (-) strand; PAM type: NRG; PAM sequence: GAG
cagctcttgccctgccatag

SEQ ID NO: 8932 - DNA, 20 bp, Artificial Sequence
  Description of Artificial Sequence: Synthetic oligonucleotide
  Target: AGXT; (-) strand; PAM type: NRG; PAM sequence: AGG
ctcagctcttgccctgccat

SEQ ID NO: 8933 - DNA, 20 bp, Artificial Sequence
  Description of Artificial Sequence: Synthetic oligonucleotide
  Target: AGXT; (-) strand; PAM type: NRG; PAM sequence: TAG
gctcagctcttgccctgcca

SEQ ID NO: 8934 - DNA, 20 bp, Artificial Sequence
  Description of Artificial Sequence: Synthetic oligonucleotide
  Target: AGXT; (-) strand; PAM type: NRG; PAM sequence: CAG
cacacccaagtgctcatgct

SEQ ID NO: 8935 - DNA, 20 bp, Artificial Sequence
  Description of Artificial Sequence: Synthetic oligonucleotide
  Target: AGXT; (-) strand; PAM type: NRG; PAM sequence: AAG
atcaacccctggtcacaccc

SEQ ID NO: 8936 - DNA, 20 bp, Artificial Sequence
  Description of Artificial Sequence: Synthetic oligonucleotide
  Target: AGXT; (-) strand; PAM type: NRG; PAM sequence: TGG
gcagtggccaaatcaacccc

SEQ ID NO: 8937 - DNA, 20 bp, Artificial Sequence
  Description of Artificial Sequence: Synthetic oligonucleotide
  Target: AGXT; (-) strand; PAM type: NRG; PAM sequence: TGG
tgagagtgtggatgttgcag

SEQ ID NO: 8938 - DNA, 20 bp, Artificial Sequence
  Description of Artificial Sequence: Synthetic oligonucleotide
  Target: AGXT; (-) strand; PAM type: NRG; PAM sequence: CAG
tcctgagagtgtggatgttg

SEQ ID NO: 8939 - DNA, 20 bp, Artificial Sequence
  Description of Artificial Sequence: Synthetic oligonucleotide
  Target: AGXT; (-) strand; PAM type: NRG; PAM sequence: TGG
gttgcagtgtcctgagagtg

SEQ ID NO: 8940 - DNA, 20 bp, Artificial Sequence
  Description of Artificial Sequence: Synthetic oligonucleotide
  Target: AGXT; (-) strand; PAM type: NRG; PAM sequence: GAG
tggatgttgcagtgtcctga

SEQ ID NO: 8941 - DNA, 20 bp, Artificial Sequence
  Description of Artificial Sequence: Synthetic oligonucleotide
  Target: AGXT; (-) strand; PAM type: NRG; PAM sequence: GAG
tgtggatgttgcagtgtcct

SEQ ID NO: 8942 - DNA, 20 bp, Artificial Sequence
  Description of Artificial Sequence: Synthetic oligonucleotide
  Target: AGXT; (-) strand; PAM type: NRG; PAM sequence: CAG
tcctgagagtgtggatgttg

SEQ ID NO: 8943 - DNA, 20 bp, Artificial Sequence
  Description of Artificial Sequence: Synthetic oligonucleotide
  Target: AGXT; (-) strand; PAM type: NRG; PAM sequence: TGG
ccgcctgtgtcctgagagtg

SEQ ID NO: 8944 - DNA, 20 bp, Artificial Sequence
  Description of Artificial Sequence: Synthetic oligonucleotide
  Target: AGXT; (-) strand; PAM type: NRG; PAM sequence: GAG
ctcagccgcctgtgtcctga

SEQ ID NO: 8945 - DNA, 20 bp, Artificial Sequence
  Description of Artificial Sequence: Synthetic oligonucleotide
  Target: AGXT; (-) strand; PAM type: NRG; PAM sequence: GAG
ctctcagccgcctgtgtcct

SEQ ID NO: 8946 - DNA, 20 bp, Artificial Sequence
  Description of Artificial Sequence: Synthetic oligonucleotide
  Target: AGXT; (-) strand; PAM type: NRG; PAM sequence: CAG
gctgggcctgaggccactct

SEQ ID NO: 8947 - DNA, 20 bp, Artificial Sequence
  Description of Artificial Sequence: Synthetic oligonucleotide
  Target: AGXT; (-) strand; PAM type: NRG; PAM sequence: AGG
ctgcagagctgctgggcctg

SEQ ID NO: 8948 - DNA, 20 bp, Artificial Sequence
  Description of Artificial Sequence: Synthetic oligonucleotide
  Target: AGXT; (-) strand; PAM type: NRG; PAM sequence: GAG
cctgcagagctgctgggcct

SEQ ID NO: 8949 - DNA, 20 bp, Artificial Sequence
  Description of Artificial Sequence: Synthetic oligonucleotide
  Target: AGXT; (-) strand; PAM type: NRG; PAM sequence: GGG
tcgtggcctgcagagctgct

SEQ ID NO: 8950 - DNA, 20 bp, Artificial Sequence
  Description of Artificial Sequence: Synthetic oligonucleotide
  Target: AGXT; (-) strand; PAM type: NRG; PAM sequence: TGG
ctcgtggcctgcagagctgc

SEQ ID NO: 8951 - DNA, 20 bp, Artificial Sequence
  Description of Artificial Sequence: Synthetic oligonucleotide
  Target: AGXT; (-) strand; PAM type: NRG; PAM sequence: GAG
ttcctgtctcgtggcctgca

SEQ ID NO: 8952 - DNA, 20 bp, Artificial Sequence
  Description of Artificial Sequence: Synthetic oligonucleotide
  Target: AGXT; (-) strand; PAM type: NRG; PAM sequence: CAG
acttcctgtctcgtggcctg

SEQ ID NO: 8953 - DNA, 20 bp, Artificial Sequence
  Description of Artificial Sequence: Synthetic oligonucleotide
  Target: AGXT; (-) strand; PAM type: NRG; PAM sequence: TGG
aggtgggacttcctgtctcg

SEQ ID NO: 8954 - DNA, 20 bp, Artificial Sequence
  Description of Artificial Sequence: Synthetic oligonucleotide
  Target: AGXT; (-) strand; PAM type: NRG; PAM sequence: GGG
ggacccagatgaaagtaggt

SEQ ID NO: 8955 - DNA, 20 bp, Artificial Sequence
  Description of Artificial Sequence: Synthetic oligonucleotide
  Target: AGXT; (-) strand; PAM type: NRG; PAM sequence: TGG
aggacccagatgaaagtagg

SEQ ID NO: 8956 - DNA, 20 bp, Artificial Sequence
  Description of Artificial Sequence: Synthetic oligonucleotide
  Target: AGXT; (-) strand; PAM type: NRG; PAM sequence: AGG
cacaggacccagatgaaagt

SEQ ID NO: 8957 - DNA, 20 bp, Artificial Sequence
  Description of Artificial Sequence: Synthetic oligonucleotide
  Target: AGXT; (-) strand; PAM type: NRG; PAM sequence: TAG
acacaggacccagatgaaag

SEQ ID NO: 8958 - DNA, 20 bp, Artificial Sequence
  Description of Artificial Sequence: Synthetic oligonucleotide
  Target: AGXT; (-) strand; PAM type: NRG; PAM sequence: AAG
gggacacaggacccagatga

SEQ ID NO: 8959 - DNA, 20 bp, Artificial Sequence
  Description of Artificial Sequence: Synthetic oligonucleotide
  Target: AGXT; (-) strand; PAM type: NRG; PAM sequence: CAG
gccctgtgggacacaggacc

SEQ ID NO: 8960 - DNA, 20 bp, Artificial Sequence
  Description of Artificial Sequence: Synthetic oligonucleotide
  Target: AGXT; (-) strand; PAM type: NRG; PAM sequence: AGG
caatgggccctgtgggacac

SEQ ID NO: 8961 - DNA, 20 bp, Artificial Sequence
  Description of Artificial Sequence: Synthetic oligonucleotide
  Target: AGXT; (-) strand; PAM type: NRG; PAM sequence: CAG
gcaatgggccctgtgggaca

SEQ ID NO: 8962 - DNA, 20 bp, Artificial Sequence
  Description of Artificial Sequence: Synthetic oligonucleotide
  Target: AGXT; (-) strand; PAM type: NRG; PAM sequence: GGG
tggctggcaatgggccctgt

SEQ ID NO: 8963 - DNA, 20 bp, Artificial Sequence
  Description of Artificial Sequence: Synthetic oligonucleotide
  Target: AGXT; (-) strand; PAM type: NRG; PAM sequence: TGG
gtggctggcaatgggccctg

SEQ ID NO: 8964 - DNA, 20 bp, Artificial Sequence
  Description of Artificial Sequence: Synthetic oligonucleotide
  Target: AGXT; (-) strand; PAM type: NRG; PAM sequence: GGG
ctggactggtggctggcaat

SEQ ID NO: 8965 - DNA, 20 bp, Artificial Sequence
  Description of Artificial Sequence: Synthetic oligonucleotide
  Target: AGXT; (-) strand; PAM type: NRG; PAM sequence: TGG
tctggactggtggctggcaa

SEQ ID NO: 8966 - DNA, 20 bp, Artificial Sequence
  Description of Artificial Sequence: Synthetic oligonucleotide
  Target: AGXT; (-) strand; PAM type: NRG; PAM sequence: TGG
ctggactctggactggtggc

SEQ ID NO: 8967 - DNA, 20 bp, Artificial Sequence
  Description of Artificial Sequence: Synthetic oligonucleotide
  Target: AGXT; (-) strand; PAM type: NRG; PAM sequence: TGG
cttcctggactctggactgg

SEQ ID NO: 8968 - DNA, 20 bp, Artificial Sequence
  Description of Artificial Sequence: Synthetic oligonucleotide
  Target: AGXT; (-) strand; PAM type: NRG; PAM sequence: TGG
atccttcctggactctggac

SEQ ID NO: 8969 - DNA, 20 bp, Artificial Sequence
  Description of Artificial Sequence: Synthetic oligonucleotide
  Target: AGXT; (-) strand; PAM type: NRG; PAM sequence: TGG
cggggatccttcctggactc

SEQ ID NO: 8970 - DNA, 20 bp, Artificial Sequence
  Description of Artificial Sequence: Synthetic oligonucleotide
  Target: AGXT; (-) strand; PAM type: NRG; PAM sequence: TGG
tgcagcccggggatccttcc

SEQ ID NO: 8971 - DNA, 20 bp, Artificial Sequence
  Description of Artificial Sequence: Synthetic oligonucleotide
  Target: AGXT; (-) strand; PAM type: NRG; PAM sequence: GGG
gggaagctggctgcagcccg

SEQ ID NO: 8972 - DNA, 20 bp, Artificial Sequence
  Description of Artificial Sequence: Synthetic oligonucleotide
  Target: AGXT; (-) strand; PAM type: NRG; PAM sequence: GGG
tgggaagctggctgcagccc

SEQ ID NO: 8973 - DNA, 20 bp, Artificial Sequence
  Description of Artificial Sequence: Synthetic oligonucleotide
  Target: AGXT; (-) strand; PAM type: NRG; PAM sequence: CGG
atgggaagctggctgcagcc

SEQ ID NO: 8974 - DNA, 20 bp, Artificial Sequence
  Description of Artificial Sequence: Synthetic oligonucleotide
  Target: AGXT; (-) strand; PAM type: NRG; PAM sequence: CAG
acctcatgggaagctggctg

SEQ ID NO: 8975 - DNA, 20 bp, Artificial Sequence
  Description of Artificial Sequence: Synthetic oligonucleotide
  Target: AGXT; (-) strand; PAM type: NRG; PAM sequence: TGG
cttgcaacctcatgggaagc

SEQ ID NO: 8976 - DNA, 20 bp, Artificial Sequence
  Description of Artificial Sequence: Synthetic oligonucleotide
  Target: AGXT; (-) strand; PAM type: NRG; PAM sequence: AAG
cggccttgcaacctcatggg

SEQ ID NO: 8977 - DNA, 20 bp, Artificial Sequence
  Description of Artificial Sequence: Synthetic oligonucleotide
  Target: AGXT; (-) strand; PAM type: NRG; PAM sequence: GGG
gcacggccttgcaacctcat

SEQ ID NO: 8978 - DNA, 20 bp, Artificial Sequence
  Description of Artificial Sequence: Synthetic oligonucleotide
  Target: AGXT; (-) strand; PAM type: NRG; PAM sequence: TGG
ggcacggccttgcaacctca

SEQ ID NO: 8979 - DNA, 20 bp, Artificial Sequence
  Description of Artificial Sequence: Synthetic oligonucleotide
  Target: AGXT; (-) strand; PAM type: NRG; PAM sequence: CGG
gaggacaaacgtggcaggca

SEQ ID NO: 8980 - DNA, 20 bp, Artificial Sequence
  Description of Artificial Sequence: Synthetic oligonucleotide
  Target: AGXT; (-) strand; PAM type: NRG; PAM sequence: AGG
cccaggaggacaaacgtggc

SEQ ID NO: 8981 - DNA, 20 bp, Artificial Sequence
  Description of Artificial Sequence: Synthetic oligonucleotide
  Target: AGXT; (-) strand; PAM type: NRG; PAM sequence: CAG
acccaggaggacaaacgtgg

SEQ ID NO: 8982 - DNA, 20 bp, Artificial Sequence
  Description of Artificial Sequence: Synthetic oligonucleotide
  Target: AGXT; (-) strand; PAM type: NRG; PAM sequence: TGG
tggacccaggaggacaaacg

SEQ ID NO: 8983 - DNA, 20 bp, Artificial Sequence
  Description of Artificial Sequence: Synthetic oligonucleotide
  Target: AGXT; (-) strand; PAM type: NRG; PAM sequence: AGG
gctttatgagtggacccagg

SEQ ID NO: 8984 - DNA, 20 bp, Artificial Sequence
  Description of Artificial Sequence: Synthetic oligonucleotide
  Target: AGXT; (-) strand; PAM type: NRG; PAM sequence: GAG
ggctttatgagtggacccag

SEQ ID NO: 8985 - DNA, 20 bp, Artificial Sequence
  Description of Artificial Sequence: Synthetic oligonucleotide
  Target: AGXT; (-) strand; PAM type: NRG; PAM sequence: AGG
gtggctttatgagtggaccc

SEQ ID NO: 8986 - DNA, 20 bp, Artificial Sequence
  Description of Artificial Sequence: Synthetic oligonucleotide
  Target: AGXT; (-) strand; PAM type: NRG; PAM sequence: CAG
agtggctttatgagtggacc

SEQ ID NO: 8987 - DNA, 20 bp, Artificial Sequence
  Description of Artificial Sequence: Synthetic oligonucleotide
  Target: AGXT; (-) strand; PAM type: NRG; PAM sequence: TGG
ctaggcagtggctttatgag

SEQ ID NO: 8988 - DNA, 20 bp, Artificial Sequence
  Description of Artificial Sequence: Synthetic oligonucleotide
  Target: AGXT; (-) strand; PAM type: NRG; PAM sequence: GAG
gccctaggcagtggctttat

SEQ ID NO: 8989 - DNA, 20 bp, Artificial Sequence
  Description of Artificial Sequence: Synthetic oligonucleotide
  Target: AGXT; (-) strand; PAM type: NRG; PAM sequence: TGG
actaacccagccctaggcag

SEQ ID NO: 8990 - DNA, 20 bp, Artificial Sequence
  Description of Artificial Sequence: Synthetic oligonucleotide
  Target: AGXT; (-) strand; PAM type: NRG; PAM sequence: CAG
ggcactaacccagccctagg

SEQ ID NO: 8991 - DNA, 20 bp, Artificial Sequence
  Description of Artificial Sequence: Synthetic oligonucleotide
  Target: AGXT; (-) strand; PAM type: NRG; PAM sequence: AGG
cctggcactaacccagccct

SEQ ID NO: 8992 - DNA, 20 bp, Artificial Sequence
  Description of Artificial Sequence: Synthetic oligonucleotide
  Target: AGXT; (-) strand; PAM type: NRG; PAM sequence: TAG
ccctggcactaacccagccc

SEQ ID NO: 8993 - DNA, 20 bp, Artificial Sequence
  Description of Artificial Sequence: Synthetic oligonucleotide
  Target: AGXT; (-) strand; PAM type: NRG; PAM sequence: CAG
ggggcaccctggcactaacc

SEQ ID NO: 8994 - DNA, 20 bp, Artificial Sequence
  Description of Artificial Sequence: Synthetic oligonucleotide
  Target: AGXT; (-) strand; PAM type: NRG; PAM sequence: TGG
tttagcttacaggggcaccc

SEQ ID NO: 8995 - DNA, 20 bp, Artificial Sequence
  Description of Artificial Sequence: Synthetic oligonucleotide
  Target: AGXT; (-) strand; PAM type: NRG; PAM sequence: GGG
gggtggcatttagcttacag

SEQ ID NO: 8996 - DNA, 20 bp, Artificial Sequence
  Description of Artificial Sequence: Synthetic oligonucleotide
  Target: AGXT; (-) strand; PAM type: NRG; PAM sequence: GGG
cgggtggcatttagcttaca

SEQ ID NO: 8997 - DNA, 20 bp, Artificial Sequence
  Description of Artificial Sequence: Synthetic oligonucleotide
  Target: AGXT; (-) strand; PAM type: NRG; PAM sequence: AGG
gcgggtggcatttagcttac

SEQ ID NO: 8998 - DNA, 20 bp, Artificial Sequence
  Description of Artificial Sequence: Synthetic oligonucleotide
  Target: AGXT; (-) strand; PAM type: NRG; PAM sequence: CAG
tgcgggtggcatttagctta

SEQ ID NO: 8999 - DNA, 20 bp, Artificial Sequence
  Description of Artificial Sequence: Synthetic oligonucleotide
  Target: AGXT; (-) strand; PAM type: NRG; PAM sequence: TAG
ccgcgggtgcgggtggcatt

SEQ ID NO: 9000 - DNA, 20 bp, Artificial Sequence
  Description of Artificial Sequence: Synthetic oligonucleotide
  Target: AGXT; (-) strand; PAM type: NRG; PAM sequence: TGG
ccttcccccgcgggtgcggg

SEQ ID NO: 9001 - DNA, 20 bp, Artificial Sequence
  Description of Artificial Sequence: Synthetic oligonucleotide
  Target: AGXT; (-) strand; PAM type: NRG; PAM sequence: GGG
tcgccttcccccgcgggtgc

SEQ ID NO: 9002 - DNA, 20 bp, Artificial Sequence
  Description of Artificial Sequence: Synthetic oligonucleotide
  Target: AGXT; (-) strand; PAM type: NRG; PAM sequence: CGG
ctcgccttcccccgcgggtg

SEQ ID NO: 9003 - DNA, 20 bp, Artificial Sequence
  Description of Artificial Sequence: Synthetic oligonucleotide
  Target: AGXT; (-) strand; PAM type: NRG; PAM sequence: GGG
gacccctcgccttcccccgc

SEQ ID NO: 9004 - DNA, 20 bp, Artificial Sequence
  Description of Artificial Sequence: Synthetic oligonucleotide
  Target: AGXT; (-) strand; PAM type: NRG; PAM sequence: CGG
tgacccctcgccttcccccg

SEQ ID NO: 9005 - DNA, 20 bp, Artificial Sequence
  Description of Artificial Sequence: Synthetic oligonucleotide
  Target: AGXT; (-) strand; PAM type: NRG; PAM sequence: GAG
cctagagcctttccctgtgt

SEQ ID NO: 9006 - DNA, 20 bp, Artificial Sequence
  Description of Artificial Sequence: Synthetic oligonucleotide
  Target: AGXT; (-) strand; PAM type: NRG; PAM sequence: GAG
cacccacctttacgacccta

SEQ ID NO: 9007 - DNA, 20 bp, Artificial Sequence
  Description of Artificial Sequence: Synthetic oligonucleotide
  Target: AGXT; (-) strand; PAM type: NRG; PAM sequence: TAG
cccacccacctttacgaccc

SEQ ID NO: 9008 - DNA, 20 bp, Artificial Sequence
  Description of Artificial Sequence: Synthetic oligonucleotide
  Target: AGXT; (-) strand; PAM type: NRG; PAM sequence: CAG
tgttctcttccttctctgcc

SEQ ID NO: 9009 - DNA, 20 bp, Artificial Sequence
  Description of Artificial Sequence: Synthetic oligonucleotide
  Target: AGXT; (-) strand; PAM type: NRG; PAM sequence: TGG
cttgactgtgccctgctgtc

SEQ ID NO: 9010 - DNA, 20 bp, Artificial Sequence
  Description of Artificial Sequence: Synthetic oligonucleotide
  Target: AGXT; (-) strand; PAM type: NRG; PAM sequence: AGG
cctgcaatctgcactctgcc

SEQ ID NO: 9011 - DNA, 20 bp, Artificial Sequence
  Description of Artificial Sequence: Synthetic oligonucleotide
  Target: AGXT; (-) strand; PAM type: NRG; PAM sequence: CAG
ccctgcaatctgcactctgc

SEQ ID NO: 9012 - DNA, 20 bp, Artificial Sequence
  Description of Artificial Sequence: Synthetic oligonucleotide
  Target: AGXT; (-) strand; PAM type: NRG; PAM sequence: TGG
gctgctctctactctggccc

SEQ ID NO: 9013 - DNA, 20 bp, Artificial Sequence
  Description of Artificial Sequence: Synthetic oligonucleotide
  Target: AGXT; (-) strand; PAM type: NRG; PAM sequence: TGG
gcagcagctgctctctactc

SEQ ID NO: 9014 - DNA, 20 bp, Artificial Sequence
  Description of Artificial Sequence: Synthetic oligonucleotide
  Target: AGXT; (-) strand; PAM type: NRG; PAM sequence: CAG
caggtgggtccccggagcag

SEQ ID NO: 9015 - DNA, 20 bp, Artificial Sequence
  Description of Artificial Sequence: Synthetic oligonucleotide
  Target: AGXT; (-) strand; PAM type: NRG; PAM sequence: CAG
ccccaggtgggtccccggag

SEQ ID NO: 9016 - DNA, 20 bp, Artificial Sequence
  Description of Artificial Sequence: Synthetic oligonucleotide
  Target: AGXT; (-) strand; PAM type: NRG; PAM sequence: GAG
ccaccccaggtgggtccccg

SEQ ID NO: 9017 - DNA, 20 bp, Artificial Sequence
  Description of Artificial Sequence: Synthetic oligonucleotide
  Target: AGXT; (-) strand; PAM type: NRG; PAM sequence: CGG
ggccaccccaggtgggtccc

SEQ ID NO: 9018 - DNA, 20 bp, Artificial Sequence
  Description of Artificial Sequence: Synthetic oligonucleotide
  Target: AGXT; (-) strand; PAM type: NRG; PAM sequence: GGG
ctctcatggccaccccaggt

SEQ ID NO: 9019 - DNA, 20 bp, Artificial Sequence
  Description of Artificial Sequence: Synthetic oligonucleotide
  Target: AGXT; (-) strand; PAM type: NRG; PAM sequence: TGG
gctctcatggccaccccagg

SEQ ID NO: 9020 - DNA, 20 bp, Artificial Sequence
  Description of Artificial Sequence: Synthetic oligonucleotide
  Target: AGXT; (-) strand; PAM type: NRG; PAM sequence: AGG
ccagctctcatggccacccc

SEQ ID NO: 9021 - DNA, 20 bp, Artificial Sequence
  Description of Artificial Sequence: Synthetic oligonucleotide
  Target: AGXT; (-) strand; PAM type: NRG; PAM sequence: CAG
accagctctcatggccaccc

SEQ ID NO: 9022 - DNA, 20 bp, Artificial Sequence
  Description of Artificial Sequence: Synthetic oligonucleotide
  Target: AGXT; (-) strand; PAM type: NRG; PAM sequence: TGG
cctccagccaccagctctca

SEQ ID NO: 9023 - DNA, 20 bp, Artificial Sequence
  Description of Artificial Sequence: Synthetic oligonucleotide
  Target: AGXT; (-) strand; PAM type: NRG; PAM sequence: CAG
tcctcccggcctccagccac

SEQ ID NO: 9024 - DNA, 20 bp, Artificial Sequence
  Description of Artificial Sequence: Synthetic oligonucleotide
  Target: AGXT; (-) strand; PAM type: NRG; PAM sequence: CAG
tcacgggtcctcccggcctc

SEQ ID NO: 9025 - DNA, 20 bp, Artificial Sequence
  Description of Artificial Sequence: Synthetic oligonucleotide
  Target: AGXT; (-) strand; PAM type: NRG; PAM sequence: CGG
cctctggtcacgggtcctcc

SEQ ID NO: 9026 - DNA, 20 bp, Artificial Sequence
  Description of Artificial Sequence: Synthetic oligonucleotide
  Target: AGXT; (-) strand; PAM type: NRG; PAM sequence: GGG
gtgccattacctctggtcac

SEQ ID NO: 9027 - DNA, 20 bp, Artificial Sequence
  Description of Artificial Sequence: Synthetic oligonucleotide
  Target: AGXT; (-) strand; PAM type: NRG; PAM sequence: CGG
agtgccattacctctggtca

SEQ ID NO: 9028 - DNA, 20 bp, Artificial Sequence
  Description of Artificial Sequence: Synthetic oligonucleotide
  Target: AGXT; (-) strand; PAM type: NRG; PAM sequence: TGG
cccctcagtgccattacctc

SEQ ID NO: 9029 - DNA, 20 bp, Artificial Sequence
  Description of Artificial Sequence: Synthetic oligonucleotide
  Target: AGXT; (-) strand; PAM type: NRG; PAM sequence: CAG
ctctccagccctgggcccct

SEQ ID NO: 9030 - DNA, 20 bp, Artificial Sequence
  Description of Artificial Sequence: Synthetic oligonucleotide
  Target: AGXT; (-) strand; PAM type: NRG; PAM sequence: GGG
ggggtggtctctccagccct

SEQ ID NO: 9031 - DNA, 20 bp, Artificial Sequence
  Description of Artificial Sequence: Synthetic oligonucleotide
  Target: AGXT; (-) strand; PAM type: NRG; PAM sequence: TGG
aggggtggtctctccagccc

SEQ ID NO: 9032 - DNA, 20 bp, Artificial Sequence
  Description of Artificial Sequence: Synthetic oligonucleotide
  Target: AGXT; (-) strand; PAM type: NRG; PAM sequence: CAG
caggtgaggggtggtctctc

SEQ ID NO: 9033 - DNA, 20 bp, Artificial Sequence
  Description of Artificial Sequence: Synthetic oligonucleotide
  Target: AGXT; (-) strand; PAM type: NRG; PAM sequence: TGG
agctctggacaggtgagggg

SEQ ID NO: 9034 - DNA, 20 bp, Artificial Sequence
  Description of Artificial Sequence: Synthetic oligonucleotide
  Target: AGXT; (-) strand; PAM type: NRG; PAM sequence: GGG
ctcagctctggacaggtgag

SEQ ID NO: 9035 - DNA, 20 bp, Artificial Sequence
  Description of Artificial Sequence: Synthetic oligonucleotide
  Target: AGXT; (-) strand; PAM type: NRG; PAM sequence: GGG
cctcagctctggacaggtga

SEQ ID NO: 9036 - DNA, 20 bp, Artificial Sequence
  Description of Artificial Sequence: Synthetic oligonucleotide
  Target: AGXT; (-) strand; PAM type: NRG; PAM sequence: AGG
gcctcagctctggacaggtg

SEQ ID NO: 9037 - DNA, 20 bp, Artificial Sequence
  Description of Artificial Sequence: Synthetic oligonucleotide
  Target: AGXT; (-) strand; PAM type: NRG; PAM sequence: GAG
tgcctcagctctggacaggt

SEQ ID NO: 9038 - DNA, 20 bp, Artificial Sequence
  Description of Artificial Sequence: Synthetic oligonucleotide
  Target: AGXT; (-) strand; PAM type: NRG; PAM sequence: AGG
ctcctgcctcagctctggac

SEQ ID NO: 9039 - DNA, 20 bp, Artificial Sequence
  Description of Artificial Sequence: Synthetic oligonucleotide
  Target: AGXT; (-) strand; PAM type: NRG; PAM sequence: CAG
gctcctgcctcagctctgga

SEQ ID NO: 9040 - DNA, 20 bp, Artificial Sequence
  Description of Artificial Sequence: Synthetic oligonucleotide
  Target: AGXT; (-) strand; PAM type: NRG; PAM sequence: TGG
cactgctcctgcctcagctc

SEQ ID NO: 9041 - DNA, 20 bp, Artificial Sequence
  Description of Artificial Sequence: Synthetic oligonucleotide
  Target: AGXT; (-) strand; PAM type: NRG; PAM sequence: CAG
ccgcagcactgctcctgcct

SEQ ID NO: 9042 - DNA, 20 bp, Artificial Sequence
  Description of Artificial Sequence: Synthetic oligonucleotide
  Target: AGXT; (-) strand; PAM type: NRG; PAM sequence: CAG
ccccgacctggcatcctccg

SEQ ID NO: 9043 - DNA, 20 bp, Artificial Sequence
  Description of Artificial Sequence: Synthetic oligonucleotide
  Target: AGXT; (-) strand; PAM type: NRG; PAM sequence: TGG
cagggccagctcccccgacc

SEQ ID NO: 9044 - DNA, 20 bp, Artificial Sequence
  Description of Artificial Sequence: Synthetic oligonucleotide
  Target: AGXT; (-) strand; PAM type: NRG; PAM sequence: CAG
gccccctctcctctcagggc

SEQ ID NO: 9045 - DNA, 20 bp, Artificial Sequence
  Description of Artificial Sequence: Synthetic oligonucleotide
  Target: AGXT; (-) strand; PAM type: NRG; PAM sequence: GGG
ccaggccccctctcctctca

SEQ ID NO: 9046 - DNA, 20 bp, Artificial Sequence
  Description of Artificial Sequence: Synthetic oligonucleotide
  Target: AGXT; (-) strand; PAM type: NRG; PAM sequence: AGG
cccaggccccctctcctctc

SEQ ID NO: 9047 - DNA, 20 bp, Artificial Sequence
  Description of Artificial Sequence: Synthetic oligonucleotide
  Target: AGXT; (-) strand; PAM type: NRG; PAM sequence: CAG
tcccaggccccctctcctct

SEQ ID NO: 9048 - DNA, 20 bp, Artificial Sequence
  Description of Artificial Sequence: Synthetic oligonucleotide
  Target: AGXT; (-) strand; PAM type: NRG; PAM sequence: AGG
ggctcagggtgctggctccc

SEQ ID NO: 9049 - DNA, 20 bp, Artificial Sequence
  Description of Artificial Sequence: Synthetic oligonucleotide
  Target: AGXT; (-) strand; PAM type: NRG; PAM sequence: CAG
gggctcagggtgctggctcc

SEQ ID NO: 9050 - DNA, 20 bp, Artificial Sequence
  Description of Artificial Sequence: Synthetic oligonucleotide
  Target: AGXT; (-) strand; PAM type: NRG; PAM sequence: TGG
agggccagggctcagggtgc

SEQ ID NO: 9051 - DNA, 20 bp, Artificial Sequence
  Description of Artificial Sequence: Synthetic oligonucleotide
  Target: AGXT; (-) strand; PAM type: NRG; PAM sequence: GGG
tggatcagggccagggctca

SEQ ID NO: 9052 - DNA, 20 bp, Artificial Sequence
  Description of Artificial Sequence: Synthetic oligonucleotide
  Target: AGXT; (-) strand; PAM type: NRG; PAM sequence: AGG
gtggatcagggccagggctc

SEQ ID NO: 9053 - DNA, 20 bp, Artificial Sequence
  Description of Artificial Sequence: Synthetic oligonucleotide
  Target: AGXT; (-) strand; PAM type: NRG; PAM sequence: CAG
agtggatcagggccagggct

SEQ ID NO: 9054 - DNA, 20 bp, Artificial Sequence
  Description of Artificial Sequence: Synthetic oligonucleotide
  Target: AGXT; (-) strand; PAM type: NRG; PAM sequence: GGG
gctggagtggatcagggcca

SEQ ID NO: 9055 - DNA, 20 bp, Artificial Sequence
  Description of Artificial Sequence: Synthetic oligonucleotide
  Target: AGXT; (-) strand; PAM type: NRG; PAM sequence: AGG
ggctggagtggatcagggcc

SEQ ID NO: 9056 - DNA, 20 bp, Artificial Sequence
  Description of Artificial Sequence: Synthetic oligonucleotide
  Target: AGXT; (-) strand; PAM type: NRG; PAM sequence: CAG
gggctggagtggatcagggc

SEQ ID NO: 9057 - DNA, 20 bp, Artificial Sequence
  Description of Artificial Sequence: Synthetic oligonucleotide
  Target: AGXT; (-) strand; PAM type: NRG; PAM sequence: GGG
cacagggctggagtggatca

SEQ ID NO: 9058 - DNA, 20 bp, Artificial Sequence
  Description of Artificial Sequence: Synthetic oligonucleotide
  Target: AGXT; (-) strand; PAM type: NRG; PAM sequence: AGG
acacagggctggagtggatc

SEQ ID NO: 9059 - DNA, 20 bp, Artificial Sequence
  Description of Artificial Sequence: Synthetic oligonucleotide
  Target: AGXT; (-) strand; PAM type: NRG; PAM sequence: CAG
tacacagggctggagtggat

SEQ ID NO: 9060 - DNA, 20 bp, Artificial Sequence
  Description of Artificial Sequence: Synthetic oligonucleotide
  Target: AGXT; (-) strand; PAM type: NRG; PAM sequence: TGG
tgggctacacagggctggag

SEQ ID NO: 9061 - DNA, 20 bp, Artificial Sequence
  Description of Artificial Sequence: Synthetic oligonucleotide
  Target: AGXT; (-) strand; PAM type: NRG; PAM sequence: GAG
tgttgggctacacagggctg

SEQ ID NO: 9062 - DNA, 20 bp, Artificial Sequence
  Description of Artificial Sequence: Synthetic oligonucleotide
  Target: AGXT; (-) strand; PAM type: NRG; PAM sequence: TGG
gctgttgggctacacagggc

SEQ ID NO: 9063 - DNA, 20 bp, Artificial Sequence
  Description of Artificial Sequence: Synthetic oligonucleotide
  Target: AGXT; (-) strand; PAM type: NRG; PAM sequence: GGG
aagggctgttgggctacaca

SEQ ID NO: 9064 - DNA, 20 bp, Artificial Sequence
  Description of Artificial Sequence: Synthetic oligonucleotide
  Target: AGXT; (-) strand; PAM type: NRG; PAM sequence: AGG
gaagggctgttgggctacac

SEQ ID NO: 9065 - DNA, 20 bp, Artificial Sequence
  Description of Artificial Sequence: Synthetic oligonucleotide
  Target: AGXT; (-) strand; PAM type: NRG; PAM sequence: CAG
ggaagggctgttgggctaca

SEQ ID NO: 9066 - DNA, 20 bp, Artificial Sequence
  Description of Artificial Sequence: Synthetic oligonucleotide
  Target: AGXT; (-) strand; PAM type: NRG; PAM sequence: GGG
caaggaggggaagggctgtt

SEQ ID NO: 9067 - DNA, 20 bp, Artificial Sequence
  Description of Artificial Sequence: Synthetic oligonucleotide
  Target: AGXT; (-) strand; PAM type: NRG; PAM sequence: TGG
gcaaggaggggaagggctgt

SEQ ID NO: 9068 - DNA, 20 bp, Artificial Sequence
  Description of Artificial Sequence: Synthetic oligonucleotide
  Target: AGXT; (-) strand; PAM type: NRG; PAM sequence: GGG
ggactgggcaaggaggggaa

SEQ ID NO: 9069 - DNA, 20 bp, Artificial Sequence
  Description of Artificial Sequence: Synthetic oligonucleotide
  Target: AGXT; (-) strand; PAM type: NRG; PAM sequence: AGG
gggactgggcaaggagggga

SEQ ID NO: 9070 - DNA, 20 bp, Artificial Sequence
  Description of Artificial Sequence: Synthetic oligonucleotide
  Target: AGXT; (-) strand; PAM type: NRG; PAM sequence: AAG
ggggactgggcaaggagggg

SEQ ID NO: 9071 - DNA, 20 bp, Artificial Sequence
  Description of Artificial Sequence: Synthetic oligonucleotide
  Target: AGXT; (-) strand; PAM type: NRG; PAM sequence: GGG
ggaggggactgggcaaggag

SEQ ID NO: 9072 - DNA, 20 bp, Artificial Sequence
  Description of Artificial Sequence: Synthetic oligonucleotide
  Target: AGXT; (-) strand; PAM type: NRG; PAM sequence: GGG
gggaggggactgggcaagga

SEQ ID NO: 9073 - DNA, 20 bp, Artificial Sequence
  Description of Artificial Sequence: Synthetic oligonucleotide
  Target: AGXT; (-) strand; PAM type: NRG; PAM sequence: AGG
ggggaggggactgggcaagg

SEQ ID NO: 9074 - DNA, 20 bp, Artificial Sequence
  Description of Artificial Sequence: Synthetic oligonucleotide
  Target: AGXT; (-) strand; PAM type: NRG; PAM sequence: GAG
gggggaggggactgggcaag

SEQ ID NO: 9075 - DNA, 20 bp, Artificial Sequence
  Description of Artificial Sequence: Synthetic oligonucleotide
  Target: AGXT; (-) strand; PAM type: NRG; PAM sequence: AGG
cagggggaggggactgggca

SEQ ID NO: 9076 - DNA, 20 bp, Artificial Sequence
  Description of Artificial Sequence: Synthetic oligonucleotide
  Target: AGXT; (-) strand; PAM type: NRG; PAM sequence: AAG
gcagggggaggggactgggc

SEQ ID NO: 9077 - DNA, 20 bp, Artificial Sequence
  Description of Artificial Sequence: Synthetic oligonucleotide
  Target: AGXT; (-) strand; PAM type: NRG; PAM sequence: GGG
ccttgcagggggaggggact

SEQ ID NO: 9078 - DNA, 20 bp, Artificial Sequence
  Description of Artificial Sequence: Synthetic oligonucleotide
  Target: AGXT; (-) strand; PAM type: NRG; PAM sequence: TGG
gccttgcagggggaggggac

SEQ ID NO: 9079 - DNA, 20 bp, Artificial Sequence
  Description of Artificial Sequence: Synthetic oligonucleotide
  Target: AGXT; (-) strand; PAM type: NRG; PAM sequence: GGG
agagtgccttgcagggggag

SEQ ID NO: 9080 - DNA, 20 bp, Artificial Sequence
  Description of Artificial Sequence: Synthetic oligonucleotide
  Target: AGXT; (-) strand; PAM type: NRG; PAM sequence: GGG
gagagtgccttgcaggggga

SEQ ID NO: 9081 - DNA, 20 bp, Artificial Sequence
  Description of Artificial Sequence: Synthetic oligonucleotide
  Target: AGXT; (-) strand; PAM type: NRG; PAM sequence: AGG
ggagagtgccttgcaggggg

SEQ ID NO: 9082 - DNA, 20 bp, Artificial Sequence
  Description of Artificial Sequence: Synthetic oligonucleotide
  Target: AGXT; (-) strand; PAM type: NRG; PAM sequence: GAG
tggagagtgccttgcagggg

SEQ ID NO: 9083 - DNA, 20 bp, Artificial Sequence
  Description of Artificial Sequence: Synthetic oligonucleotide
  Target: AGXT; (-) strand; PAM type: NRG; PAM sequence: GGG
agtggagagtgccttgcagg

SEQ ID NO: 9084 - DNA, 20 bp, Artificial Sequence
  Description of Artificial Sequence: Synthetic oligonucleotide
  Target: AGXT; (-) strand; PAM type: NRG; PAM sequence: GGG
gagtggagagtgccttgcag

SEQ ID NO: 9085 - DNA, 20 bp, Artificial Sequence
  Description of Artificial Sequence: Synthetic oligonucleotide
  Target: AGXT; (-) strand; PAM type: NRG; PAM sequence: GGG
agagtggagagtgccttgca

SEQ ID NO: 9086 - DNA, 20 bp, Artificial Sequence
  Description of Artificial Sequence: Synthetic oligonucleotide
  Target: AGXT; (-) strand; PAM type: NRG; PAM sequence: AGG
aagagtggagagtgccttgc

SEQ ID NO: 9087 - DNA, 20 bp, Artificial Sequence
  Description of Artificial Sequence: Synthetic oligonucleotide
  Target: AGXT; (-) strand; PAM type: NRG; PAM sequence: CAG
gaagagtggagagtgccttg

SEQ ID NO: 9088 - DNA, 20 bp, Artificial Sequence
  Description of Artificial Sequence: Synthetic oligonucleotide
  Target: AGXT; (-) strand; PAM type: NRG; PAM sequence: GAG
ccctgggggagaagagtgga

SEQ ID NO: 9089 - DNA, 20 bp, Artificial Sequence
  Description of Artificial Sequence: Synthetic oligonucleotide
  Target: AGXT; (-) strand; PAM type: NRG; PAM sequence: GAG
gcccctgggggagaagagtg

SEQ ID NO: 9090 - DNA, 20 bp, Artificial Sequence
  Description of Artificial Sequence: Synthetic oligonucleotide
  Target: AGXT; (-) strand; PAM type: NRG; PAM sequence: TGG
tggcccctgggggagaagag

SEQ ID NO: 9091 - DNA, 20 bp, Artificial Sequence
  Description of Artificial Sequence: Synthetic oligonucleotide
  Target: AGXT; (-) strand; PAM type: NRG; PAM sequence: GAG
ctgtggcccctgggggagaa

SEQ ID NO: 9092 - DNA, 20 bp, Artificial Sequence
  Description of Artificial Sequence: Synthetic oligonucleotide
  Target: AGXT; (-) strand; PAM type: NRG; PAM sequence: AAG
gcctgtggcccctgggggag

SEQ ID NO: 9093 - DNA, 20 bp, Artificial Sequence
  Description of Artificial Sequence: Synthetic oligonucleotide
  Target: AGXT; (-) strand; PAM type: NRG; PAM sequence: GAG
tctgcctgtggcccctgggg

SEQ ID NO: 9094 - DNA, 20 bp, Artificial Sequence
  Description of Artificial Sequence: Synthetic oligonucleotide
  Target: AGXT; (-) strand; PAM type: NRG; PAM sequence: GGG
ggtctgcctgtggcccctgg

SEQ ID NO: 9095 - DNA, 20 bp, Artificial Sequence
  Description of Artificial Sequence: Synthetic oligonucleotide
  Target: AGXT; (-) strand; PAM type: NRG; PAM sequence: GGG
aggtctgcctgtggcccctg

SEQ ID NO: 9096 - DNA, 20 bp, Artificial Sequence
  Description of Artificial Sequence: Synthetic oligonucleotide
  Target: AGXT; (-) strand; PAM type: NRG; PAM sequence: GGG
gaggtctgcctgtggcccct

SEQ ID NO: 9097 - DNA, 20 bp, Artificial Sequence
  Description of Artificial Sequence: Synthetic oligonucleotide
  Target: AGXT; (-) strand; PAM type: NRG; PAM sequence: TGG
ggaggtctgcctgtggcccc

SEQ ID NO: 9098 - DNA, 20 bp, Artificial Sequence
  Description of Artificial Sequence: Synthetic oligonucleotide
  Target: AGXT; (-) strand; PAM type: NRG; PAM sequence: TGG
acagaggggaggtctgcctg

SEQ ID NO: 9099 - DNA, 20 bp, Artificial Sequence
  Description of Artificial Sequence: Synthetic oligonucleotide
  Target: AGXT; (-) strand; PAM type: NRG; PAM sequence: AGG
ggttcagagagacagagggg

SEQ ID NO: 9100 - DNA, 20 bp, Artificial Sequence
  Description of Artificial Sequence: Synthetic oligonucleotide
  Target: AGXT; (-) strand; PAM type: NRG; PAM sequence: GAG
gggttcagagagacagaggg

SEQ ID NO: 9101 - DNA, 20 bp, Artificial Sequence
  Description of Artificial Sequence: Synthetic oligonucleotide
  Target: AGXT; (-) strand; PAM type: NRG; PAM sequence: GGG
gagggttcagagagacagag

SEQ ID NO: 9102 - DNA, 20 bp, Artificial Sequence
  Description of Artificial Sequence: Synthetic oligonucleotide
  Target: AGXT; (-) strand; PAM type: NRG; PAM sequence: GGG
ggagggttcagagagacaga

SEQ ID NO: 9103 - DNA, 20 bp, Artificial Sequence
  Description of Artificial Sequence: Synthetic oligonucleotide
  Target: AGXT; (-) strand; PAM type: NRG; PAM sequence: AGG
aggagggttcagagagacag

SEQ ID NO: 9104 - DNA, 20 bp, Artificial Sequence
  Description of Artificial Sequence: Synthetic oligonucleotide
  Target: AGXT; (-) strand; PAM type: NRG; PAM sequence: GAG
gaggagggttcagagagaca

SEQ ID NO: 9105 - DNA, 20 bp, Artificial Sequence
  Description of Artificial Sequence: Synthetic oligonucleotide
  Target: AGXT; (-) strand; PAM type: NRG; PAM sequence: CAG
cagaggagggttcagagaga

SEQ ID NO: 9106 - DNA, 20 bp, Artificial Sequence
  Description of Artificial Sequence: Synthetic oligonucleotide
  Target: AGXT; (-) strand; PAM type: NRG; PAM sequence: GAG
gagacagaggagggttcaga

SEQ ID NO: 9107 - DNA, 20 bp, Artificial Sequence
  Description of Artificial Sequence: Synthetic oligonucleotide
  Target: AGXT; (-) strand; PAM type: NRG; PAM sequence: GAG
gagagacagaggagggttca

SEQ ID NO: 9108 - DNA, 20 bp, Artificial Sequence
  Description of Artificial Sequence: Synthetic oligonucleotide
  Target: AGXT; (-) strand; PAM type: NRG; PAM sequence: CAG
gggagagacagaggagggtt

SEQ ID NO: 9109 - DNA, 20 bp, Artificial Sequence
  Description of Artificial Sequence: Synthetic oligonucleotide
  Target: AGXT; (-) strand; PAM type: NRG; PAM sequence: GGG
ggtctgggagagacagagga

SEQ ID NO: 9110 - DNA, 20 bp, Artificial Sequence
  Description of Artificial Sequence: Synthetic oligonucleotide
  Target: AGXT; (-) strand; PAM type: NRG; PAM sequence: AGG
gggtctgggagagacagagg

SEQ ID NO: 9111 - DNA, 20 bp, Artificial Sequence
  Description of Artificial Sequence: Synthetic oligonucleotide
  Target: AGXT; (-) strand; PAM type: NRG; PAM sequence: GAG
tgggtctgggagagacagag

SEQ ID NO: 9112 - DNA, 20 bp, Artificial Sequence
  Description of Artificial Sequence: Synthetic oligonucleotide
  Target: AGXT; (-) strand; PAM type: NRG; PAM sequence: AGG
tctgggtctgggagagacag

SEQ ID NO: 9113 - DNA, 20 bp, Artificial Sequence
  Description of Artificial Sequence: Synthetic oligonucleotide
  Target: AGXT; (-) strand; PAM type: NRG; PAM sequence: GAG
atctgggtctgggagagaca

SEQ ID NO: 9114 - DNA, 20 bp, Artificial Sequence
  Description of Artificial Sequence: Synthetic oligonucleotide
  Target: AGXT; (-) strand; PAM type: NRG; PAM sequence: CAG
acatctgggtctgggagaga

SEQ ID NO: 9115 - DNA, 20 bp, Artificial Sequence
  Description of Artificial Sequence: Synthetic oligonucleotide
  Target: AGXT; (-) strand; PAM type: NRG; PAM sequence: GAG
ggaaacatctgggtctggga

SEQ ID NO: 9116 - DNA, 20 bp, Artificial Sequence
  Description of Artificial Sequence: Synthetic oligonucleotide
  Target: AGXT; (-) strand; PAM type: NRG; PAM sequence: GAG
aaggaaacatctgggtctgg

SEQ ID NO: 9117 - DNA, 20 bp, Artificial Sequence
  Description of Artificial Sequence: Synthetic oligonucleotide
  Target: AGXT; (-) strand; PAM type: NRG; PAM sequence: GGG
agaaggaaacatctgggtct

SEQ ID NO: 9118 - DNA, 20 bp, Artificial Sequence
  Description of Artificial Sequence: Synthetic oligonucleotide
  Target: AGXT; (-) strand; PAM type: NRG; PAM sequence: TGG
cagaaggaaacatctgggtc

SEQ ID NO: 9119 - DNA, 20 bp, Artificial Sequence
  Description of Artificial Sequence: Synthetic oligonucleotide
  Target: AGXT; (-) strand; PAM type: NRG; PAM sequence: GGG
cagggcagaaggaaacatct

SEQ ID NO: 9120 - DNA, 20 bp, Artificial Sequence
  Description of Artificial Sequence: Synthetic oligonucleotide
  Target: AGXT; (-) strand; PAM type: NRG; PAM sequence: TGG
ccagggcagaaggaaacatc

SEQ ID NO: 9121 - DNA, 20 bp, Artificial Sequence
  Description of Artificial Sequence: Synthetic oligonucleotide
  Target: AGXT; (-) strand; PAM type: NRG; PAM sequence: AGG
tgggactaccccagggcaga

SEQ ID NO: 9122 - DNA, 20 bp, Artificial Sequence
  Description of Artificial Sequence: Synthetic oligonucleotide
  Target: AGXT; (-) strand; PAM type: NRG; PAM sequence: AAG
ctgggactaccccagggcag

SEQ ID NO: 9123 - DNA, 20 bp, Artificial Sequence
  Description of Artificial Sequence: Synthetic oligonucleotide
  Target: AGXT; (-) strand; PAM type: NRG; PAM sequence: CAG
ggcctgggactaccccaggg

SEQ ID NO: 9124 - DNA, 20 bp, Artificial Sequence
  Description of Artificial Sequence: Synthetic oligonucleotide
  Target: AGXT; (-) strand; PAM type: NRG; PAM sequence: GGG
cagggcctgggactacccca

SEQ ID NO: 9125 - DNA, 20 bp, Artificial Sequence
  Description of Artificial Sequence: Synthetic oligonucleotide
  Target: AGXT; (-) strand; PAM type: NRG; PAM sequence: AGG
gcagggcctgggactacccc

SEQ ID NO: 9126 - DNA, 20 bp, Artificial Sequence
  Description of Artificial Sequence: Synthetic oligonucleotide
  Target: AGXT; (-) strand; PAM type: NRG; PAM sequence: CAG
ggcagggcctgggactaccc

SEQ ID NO: 9127 - DNA, 20 bp, Artificial Sequence
  Description of Artificial Sequence: Synthetic oligonucleotide
  Target: AGXT; (-) strand; PAM type: NRG; PAM sequence: GGG
ctttgcctggggcagggcct

SEQ ID NO: 9128 - DNA, 20 bp, Artificial Sequence
  Description of Artificial Sequence: Synthetic oligonucleotide
  Target: AGXT; (-) strand; PAM type: NRG; PAM sequence: TGG
actttgcctggggcagggcc

SEQ ID NO: 9129 - DNA, 20 bp, Artificial Sequence
  Description of Artificial Sequence: Synthetic oligonucleotide
  Target: AGXT; (-) strand; PAM type: NRG; PAM sequence: GGG
gtttgactttgcctggggca

SEQ ID NO: 9130 - DNA, 20 bp, Artificial Sequence
  Description of Artificial Sequence: Synthetic oligonucleotide
  Target: AGXT; (-) strand; PAM type: NRG; PAM sequence: AGG
agtttgactttgcctggggc

SEQ ID NO: 9131 - DNA, 20 bp, Artificial Sequence
  Description of Artificial Sequence: Synthetic oligonucleotide
  Target: AGXT; (-) strand; PAM type: NRG; PAM sequence: CAG
cagtttgactttgcctgggg

SEQ ID NO: 9132 - DNA, 20 bp, Artificial Sequence
  Description of Artificial Sequence: Synthetic oligonucleotide
  Target: AGXT; (-) strand; PAM type: NRG; PAM sequence: GGG
ccccagtttgactttgcctg

SEQ ID NO: 9133 - DNA, 20 bp, Artificial Sequence
  Description of Artificial Sequence: Synthetic oligonucleotide
  Target: AGXT; (-) strand; PAM type: NRG; PAM sequence: GGG
cccccagtttgactttgcct

SEQ ID NO: 9134 - DNA, 20 bp, Artificial Sequence
  Description of Artificial Sequence: Synthetic oligonucleotide
  Target: AGXT; (-) strand; PAM type: NRG; PAM sequence: TGG
gcccccagtttgactttgcc

SEQ ID NO: 9135 - DNA, 20 bp, Artificial Sequence
  Description of Artificial Sequence: Synthetic oligonucleotide
  Target: AGXT; (-) strand; PAM type: NRG; PAM sequence: CAG
aggggagcccctggagcccc

SEQ ID NO: 9136 - DNA, 20 bp, Artificial Sequence
  Description of Artificial Sequence: Synthetic oligonucleotide
  Target: AGXT; (-) strand; PAM type: NRG; PAM sequence: GAG
ttggtgcaggggagcccctg

SEQ ID NO: 9137 - DNA, 20 bp, Artificial Sequence
  Description of Artificial Sequence: Synthetic oligonucleotide
  Target: AGXT; (-) strand; PAM type: NRG; PAM sequence: TGG
ccttggtgcaggggagcccc

SEQ ID NO: 9138 - DNA, 20 bp, Artificial Sequence
  Description of Artificial Sequence: Synthetic oligonucleotide
  Target: AGXT; (-) strand; PAM type: NRG; PAM sequence: GAG
ctgcaggccttggtgcaggg

SEQ ID NO: 9139 - DNA, 20 bp, Artificial Sequence
  Description of Artificial Sequence: Synthetic oligonucleotide
  Target: AGXT; (-) strand; PAM type: NRG; PAM sequence: GGG
ctctgcaggccttggtgcag

SEQ ID NO: 9140 - DNA, 20 bp, Artificial Sequence
  Description of Artificial Sequence: Synthetic oligonucleotide
  Target: AGXT; (-) strand; PAM type: NRG; PAM sequence: GGG
actctgcaggccttggtgca

SEQ ID NO: 9141 - DNA, 20 bp, Artificial Sequence
  Description of Artificial Sequence: Synthetic oligonucleotide
  Target: AGXT; (-) strand; PAM type: NRG; PAM sequence: AGG
gactctgcaggccttggtgc

SEQ ID NO: 9142 - DNA, 20 bp, Artificial Sequence
  Description of Artificial Sequence: Synthetic oligonucleotide
  Target: AGXT; (-) strand; PAM type: NRG; PAM sequence: CAG
tgactctgcaggccttggtg

SEQ ID NO: 9143 - DNA, 20 bp, Artificial Sequence
  Description of Artificial Sequence: Synthetic oligonucleotide
  Target: AGXT; (-) strand; PAM type: NRG; PAM sequence: TGG
gaacctgactctgcaggcct

SEQ ID NO: 9144 - DNA, 20 bp, Artificial Sequence
  Description of Artificial Sequence: Synthetic oligonucleotide
  Target: AGXT; (-) strand; PAM type: NRG; PAM sequence: AGG
gaggaagaacctgactctgc

SEQ ID NO: 9145 - DNA, 20 bp, Artificial Sequence
  Description of Artificial Sequence: Synthetic oligonucleotide
  Target: AGXT; (-) strand; PAM type: NRG; PAM sequence: CAG
ggaggaagaacctgactctg

SEQ ID NO: 9146 - DNA, 20 bp, Artificial Sequence
  Description of Artificial Sequence: Synthetic oligonucleotide
  Target: AGXT; (-) strand; PAM type: NRG; PAM sequence: AAG
gccctctgtggtgcgggagg

SEQ ID NO: 9147 - DNA, 20 bp, Artificial Sequence
  Description of Artificial Sequence: Synthetic oligonucleotide
  Target: AGXT; (-) strand; PAM type: NRG; PAM sequence: AGG
cccgccctctgtggtgcggg

SEQ ID NO: 9148 - DNA, 20 bp, Artificial Sequence
  Description of Artificial Sequence: Synthetic oligonucleotide
  Target: AGXT; (-) strand; PAM type: NRG; PAM sequence: GAG
ccccgccctctgtggtgcgg

SEQ ID NO: 9149 - DNA, 20 bp, Artificial Sequence
  Description of Artificial Sequence: Synthetic oligonucleotide
  Target: AGXT; (-) strand; PAM type: NRG; PAM sequence: GGG
agccccgccctctgtggtgc

SEQ ID NO: 9150 - DNA, 20 bp, Artificial Sequence
  Description of Artificial Sequence: Synthetic oligonucleotide
  Target: AGXT; (-) strand; PAM type: NRG; PAM sequence: CGG
aagccccgccctctgtggtg

SEQ ID NO: 9151 - DNA, 20 bp, Artificial Sequence
  Description of Artificial Sequence: Synthetic oligonucleotide
  Target: AGXT; (-) strand; PAM type: NRG; PAM sequence: TGG
gcaggaagccccgccctctg

SEQ ID NO: 9152 - DNA, 20 bp, Artificial Sequence
  Description of Artificial Sequence: Synthetic oligonucleotide
  Target: AGXT; (-) strand; PAM type: NRG; PAM sequence: AAG
acatgggtggggtgggcagg

SEQ ID NO: 9153 - DNA, 20 bp, Artificial Sequence
  Description of Artificial Sequence: Synthetic oligonucleotide
  Target: AGXT; (-) strand; PAM type: NRG; PAM sequence: AGG
gtgacatgggtggggtgggc

SEQ ID NO: 9154 - DNA, 20 bp, Artificial Sequence
  Description of Artificial Sequence: Synthetic oligonucleotide
  Target: AGXT; (-) strand; PAM type: NRG; PAM sequence: CAG
agtgacatgggtggggtggg

SEQ ID NO: 9155 - DNA, 20 bp, Artificial Sequence
  Description of Artificial Sequence: Synthetic oligonucleotide
  Target: AGXT; (-) strand; PAM type: NRG; PAM sequence: GGG
ggcagtgacatgggtggggt

SEQ ID NO: 9156 - DNA, 20 bp, Artificial Sequence
  Description of Artificial Sequence: Synthetic oligonucleotide
  Target: AGXT; (-) strand; PAM type: NRG; PAM sequence: TGG
gggcagtgacatgggtgggg

SEQ ID NO: 9157 - DNA, 20 bp, Artificial Sequence
  Description of Artificial Sequence: Synthetic oligonucleotide
  Target: AGXT; (-) strand; PAM type: NRG; PAM sequence: GGG
ggtgggcagtgacatgggtg

SEQ ID NO: 9158 - DNA, 20 bp, Artificial Sequence
  Description of Artificial Sequence: Synthetic oligonucleotide
  Target: AGXT; (-) strand; PAM type: NRG; PAM sequence: GGG
tggtgggcagtgacatgggt

SEQ ID NO: 9159 - DNA, 20 bp, Artificial Sequence
  Description of Artificial Sequence: Synthetic oligonucleotide
  Target: AGXT; (-) strand; PAM type: NRG; PAM sequence: TGG
ctggtgggcagtgacatggg

SEQ ID NO: 9160 - DNA, 20 bp, Artificial Sequence
  Description of Artificial Sequence: Synthetic oligonucleotide
  Target: AGXT; (-) strand; PAM type: NRG; PAM sequence: GGG
gcgctggtgggcagtgacat

SEQ ID NO: 9161 - DNA, 20 bp, Artificial Sequence
  Description of Artificial Sequence: Synthetic oligonucleotide
  Target: AGXT; (-) strand; PAM type: NRG; PAM sequence: TGG
ggcgctggtgggcagtgaca

SEQ ID NO: 9162 - DNA, 20 bp, Artificial Sequence
  Description of Artificial Sequence: Synthetic oligonucleotide
  Target: AGXT; (-) strand; PAM type: NRG; PAM sequence: CAG
tgggagatggcgctggtggg

SEQ ID NO: 9163 - DNA, 20 bp, Artificial Sequence
  Description of Artificial Sequence: Synthetic oligonucleotide
  Target: AGXT; (-) strand; PAM type: NRG; PAM sequence: GGG
gtgtgggagatggcgctggt

SEQ ID NO: 9164 - DNA, 20 bp, Artificial Sequence
  Description of Artificial Sequence: Synthetic oligonucleotide
  Target: AGXT; (-) strand; PAM type: NRG; PAM sequence: TGG
tgtgtgggagatggcgctgg

SEQ ID NO: 9165 - DNA, 20 bp, Artificial Sequence
  Description of Artificial Sequence: Synthetic oligonucleotide
  Target: AGXT; (-) strand; PAM type: NRG; PAM sequence: TGG
ccctgtgtgggagatggcgc

SEQ ID NO: 9166 - DNA, 20 bp, Artificial Sequence
  Description of Artificial Sequence: Synthetic oligonucleotide
  Target: AGXT; (-) strand; PAM type: NRG; PAM sequence: TGG
tccaggccctgtgtgggaga

SEQ ID NO: 9167 - DNA, 20 bp, Artificial Sequence
  Description of Artificial Sequence: Synthetic oligonucleotide
  Target: AGXT; (-) strand; PAM type: NRG; PAM sequence: GAG
gttctccaggccctgtgtgg

SEQ ID NO: 9168 - DNA, 20 bp, Artificial Sequence
  Description of Artificial Sequence: Synthetic oligonucleotide
  Target: AGXT; (-) strand; PAM type: NRG; PAM sequence: GGG
ctgttctccaggccctgtgt

SEQ ID NO: 9169 - DNA, 20 bp, Artificial Sequence
  Description of Artificial Sequence: Synthetic oligonucleotide
  Target: AGXT; (-) strand; PAM type: NRG; PAM sequence: TGG
gctgttctccaggccctgtg

SEQ ID NO: 9170 - DNA, 20 bp, Artificial Sequence
  Description of Artificial Sequence: Synthetic oligonucleotide
  Target: AGXT; (-) strand; PAM type: NRG; PAM sequence: AGG
gctggcgccagctgttctcc

SEQ ID NO: 9171 - DNA, 20 bp, Artificial Sequence
  Description of Artificial Sequence: Synthetic oligonucleotide
  Target: AGXT; (-) strand; PAM type: NRG; PAM sequence: CAG
tgctggcgccagctgttctc

SEQ ID NO: 9172 - DNA, 20 bp, Artificial Sequence
  Description of Artificial Sequence: Synthetic oligonucleotide
  Target: AGXT; (-) strand; PAM type: NRG; PAM sequence: CAG
cggcctcgcggtgctggcgc

SEQ ID NO: 9173 - DNA, 20 bp, Artificial Sequence
  Description of Artificial Sequence: Synthetic oligonucleotide
  Target: AGXT; (-) strand; PAM type: NRG; PAM sequence: TGG
acgccgcggcctcgcggtgc

SEQ ID NO: 9174 - DNA, 20 bp, Artificial Sequence
  Description of Artificial Sequence: Synthetic oligonucleotide
  Target: AGXT; (-) strand; PAM type: NRG; PAM sequence: CGG
gcagatacgccgcggcctcg

SEQ ID NO: 9175 - DNA, 20 bp, Artificial Sequence
  Description of Artificial Sequence: Synthetic oligonucleotide
  Target: AGXT; (-) strand; PAM type: NRG; PAM sequence: CGG
gcgcccatgcagatacgccg

SEQ ID NO: 9176 - DNA, 20 bp, Artificial Sequence
  Description of Artificial Sequence: Synthetic oligonucleotide
  Target: AGXT; (-) strand; PAM type: NRG; PAM sequence: CAG
agtgcctgcaggcgcccatg

SEQ ID NO: 9177 - DNA, 20 bp, Artificial Sequence
  Description of Artificial Sequence: Synthetic oligonucleotide
  Target: AGXT; (-) strand; PAM type: NRG; PAM sequence: AGG
gctgcagccccagtgcctgc

SEQ ID NO: 9178 - DNA, 20 bp, Artificial Sequence
  Description of Artificial Sequence: Synthetic oligonucleotide
  Target: AGXT; (-) strand; PAM type: NRG; PAM sequence: CAG
agctgcagccccagtgcctg

SEQ ID NO: 9179 - DNA, 20 bp, Artificial Sequence
  Description of Artificial Sequence: Synthetic oligonucleotide
  Target: AGXT; (-) strand; PAM type: NRG; PAM sequence: CAG
ttcacgaagagctgcagccc

SEQ ID NO: 9180 - DNA, 20 bp, Artificial Sequence
  Description of Artificial Sequence: Synthetic oligonucleotide
  Target: AGXT; (-) strand; PAM type: NRG; PAM sequence: CAG
gggtccttcacgaagagctg

SEQ ID NO: 9181 - DNA, 20 bp, Artificial Sequence
  Description of Artificial Sequence: Synthetic oligonucleotide
  Target: AGXT; (-) strand; PAM type: NRG; PAM sequence: GAG
cttaccgggtccttcacgaa

SEQ ID NO: 9182 - DNA, 20 bp, Artificial Sequence
  Description of Artificial Sequence: Synthetic oligonucleotide
  Target: AGXT; (-) strand; PAM type: NRG; PAM sequence: AAG
tccttaccgggtccttcacg

SEQ ID NO: 9183 - DNA, 20 bp, Artificial Sequence
  Description of Artificial Sequence: Synthetic oligonucleotide
  Target: AGXT; (-) strand; PAM type: NRG; PAM sequence: GGG
atgccaggggcctccttacc

SEQ ID NO: 9184 - DNA, 20 bp, Artificial Sequence
  Description of Artificial Sequence: Synthetic oligonucleotide
  Target: AGXT; (-) strand; PAM type: NRG; PAM sequence: CGG
aatgccaggggcctccttac

SEQ ID NO: 9185 - DNA, 20 bp, Artificial Sequence
  Description of Artificial Sequence: Synthetic oligonucleotide
  Target: AGXT; (-) strand; PAM type: NRG; PAM sequence: GGG
gcagggctgcccaatgccag

SEQ ID NO: 9186 - DNA, 20 bp, Artificial Sequence
  Description of Artificial Sequence: Synthetic oligonucleotide
  Target: AGXT; (-) strand; PAM type: NRG; PAM sequence: GGG
tgcagggctgcccaatgcca

SEQ ID NO: 9187 - DNA, 20 bp, Artificial Sequence
  Description of Artificial Sequence: Synthetic oligonucleotide
  Target: AGXT; (-) strand; PAM type: NRG; PAM sequence: AGG
gtgcagggctgcccaatgcc

SEQ ID NO: 9188 - DNA, 20 bp, Artificial Sequence
  Description of Artificial Sequence: Synthetic oligonucleotide
  Target: AGXT; (-) strand; PAM type: NRG; PAM sequence: CAG
ggtgcagggctgcccaatgc

SEQ ID NO: 9189 - DNA, 20 bp, Artificial Sequence
  Description of Artificial Sequence: Synthetic oligonucleotide
  Target: AGXT; (-) strand; PAM type: NRG; PAM sequence: GGG
catccttccccatgggtgca

SEQ ID NO: 9190 - DNA, 20 bp, Artificial Sequence
  Description of Artificial Sequence: Synthetic oligonucleotide
  Target: AGXT; (-) strand; PAM type: NRG; PAM sequence: AGG
tcatccttccccatgggtgc

SEQ ID NO: 9191 - DNA, 20 bp, Artificial Sequence
  Description of Artificial Sequence: Synthetic oligonucleotide
  Target: AGXT; (-) strand; PAM type: NRG; PAM sequence: CAG
ctcatccttccccatgggtg

SEQ ID NO: 9192 - DNA, 20 bp, Artificial Sequence
  Description of Artificial Sequence: Synthetic oligonucleotide
  Target: AGXT; (-) strand; PAM type: NRG; PAM sequence: GGG
agcccctcatccttccccat

SEQ ID NO: 9193 - DNA, 20 bp, Artificial Sequence
  Description of Artificial Sequence: Synthetic oligonucleotide
  Target: AGXT; (-) strand; PAM type: NRG; PAM sequence: TGG
gagcccctcatccttcccca

SEQ ID NO: 9194 - DNA, 20 bp, Artificial Sequence
  Description of Artificial Sequence: Synthetic oligonucleotide
  Target: AGXT; (-) strand; PAM type: NRG; PAM sequence: GAG
ctcttgagggggctgggcaa

SEQ ID NO: 9195 - DNA, 20 bp, Artificial Sequence
  Description of Artificial Sequence: Synthetic oligonucleotide
  Target: AGXT; (-) strand; PAM type: NRG; PAM sequence: AAG
ccctcttgagggggctgggc

SEQ ID NO: 9196 - DNA, 20 bp, Artificial Sequence
  Description of Artificial Sequence: Synthetic oligonucleotide
  Target: AGXT; (-) strand; PAM type: NRG; PAM sequence: GGG
gtgtccctcttgagggggct

SEQ ID NO: 9197 - DNA, 20 bp, Artificial Sequence
  Description of Artificial Sequence: Synthetic oligonucleotide
  Target: AGXT; (-) strand; PAM type: NRG; PAM sequence: TGG
agtgtccctcttgagggggc

SEQ ID NO: 9198 - DNA, 20 bp, Artificial Sequence
  Description of Artificial Sequence: Synthetic oligonucleotide
  Target: AGXT; (-) strand; PAM type: NRG; PAM sequence: GGG
agccagtgtccctcttgagg

SEQ ID NO: 9199 - DNA, 20 bp, Artificial Sequence
  Description of Artificial Sequence: Synthetic oligonucleotide
  Target: AGXT; (-) strand; PAM type: NRG; PAM sequence: GGG
gagccagtgtccctcttgag

SEQ ID NO: 9200 - DNA, 20 bp, Artificial Sequence
  Description of Artificial Sequence: Synthetic oligonucleotide
  Target: AGXT; (-) strand; PAM type: NRG; PAM sequence: GGG
ggagccagtgtccctcttga

SEQ ID NO: 9201 - DNA, 20 bp, Artificial Sequence
  Description of Artificial Sequence: Synthetic oligonucleotide
  Target: AGXT; (-) strand; PAM type: NRG; PAM sequence: AGG
aggagccagtgtccctcttg

SEQ ID NO: 9202 - DNA, 20 bp, Artificial Sequence
  Description of Artificial Sequence: Synthetic oligonucleotide
  Target: AGXT; (-) strand; PAM type: NRG; PAM sequence: GAG
caggagccagtgtccctctt

SEQ ID NO: 9203 - DNA, 20 bp, Artificial Sequence
  Description of Artificial Sequence: Synthetic oligonucleotide
  Target: AGXT; (-) strand; PAM type: NRG; PAM sequence: CAG
gccccctccttctcaggagc

SEQ ID NO: 9204 - DNA, 20 bp, Artificial Sequence
  Description of Artificial Sequence: Synthetic oligonucleotide
  Target: AGXT; (-) strand; PAM type: NRG; PAM sequence: GAG
agccgccccctccttctcag

SEQ ID NO: 9205 - DNA, 20 bp, Artificial Sequence
  Description of Artificial Sequence: Synthetic oligonucleotide
  Target: AGXT; (-) strand; PAM type: NRG; PAM sequence: AGG
gcagccgccccctccttctc

SEQ ID NO: 9206 - DNA, 20 bp, Artificial Sequence
  Description of Artificial Sequence: Synthetic oligonucleotide
  Target: AGXT; (-) strand; PAM type: NRG; PAM sequence: CAG
ggcagccgccccctccttct

SEQ ID NO: 9207 - DNA, 20 bp, Artificial Sequence
  Description of Artificial Sequence: Synthetic oligonucleotide
  Target: AGXT; (-) strand; PAM type: NRG; PAM sequence: CAG
accgaggccacaccaccggg

SEQ ID NO: 9208 - DNA, 20 bp, Artificial Sequence
  Description of Artificial Sequence: Synthetic oligonucleotide
  Target: AGXT; (-) strand; PAM type: NRG; PAM sequence: GGG
ggcaccgaggccacaccacc

SEQ ID NO: 9209 - DNA, 20 bp, Artificial Sequence
  Description of Artificial Sequence: Synthetic oligonucleotide
  Target: AGXT; (-) strand; PAM type: NRG; PAM sequence: CGG
tggcaccgaggccacaccac

SEQ ID NO: 9210 - DNA, 20 bp, Artificial Sequence
  Description of Artificial Sequence: Synthetic oligonucleotide
  Target: AGXT; (-) strand; PAM type: NRG; PAM sequence: AGG
gagactaatccctggcaccg

SEQ ID NO: 9211 - DNA, 20 bp, Artificial Sequence
  Description of Artificial Sequence: Synthetic oligonucleotide
  Target: AGXT; (-) strand; PAM type: NRG; PAM sequence: GAG
cgagactaatccctggcacc

SEQ ID NO: 9212 - DNA, 20 bp, Artificial Sequence
  Description of Artificial Sequence: Synthetic oligonucleotide
  Target: AGXT; (-) strand; PAM type: NRG; PAM sequence: TGG
ctcctgccgagactaatccc

SEQ ID NO: 9213 - DNA, 20 bp, Artificial Sequence
  Description of Artificial Sequence: Synthetic oligonucleotide
  Target: AGXT; (-) strand; PAM type: NRG; PAM sequence: GAG
gtgacttcgtggctcctgcc

SEQ ID NO: 9214 - DNA, 20 bp, Artificial Sequence
  Description of Artificial Sequence: Synthetic oligonucleotide
  Target: AGXT; (-) strand; PAM type: NRG; PAM sequence: TGG
ggccgggagctgtgacttcg

SEQ ID NO: 9215 - DNA, 20 bp, Artificial Sequence
  Description of Artificial Sequence: Synthetic oligonucleotide
  Target: AGXT; (-) strand; PAM type: NRG; PAM sequence: GAG
gatcccgcatcagaggccgg

SEQ ID NO: 9216 - DNA, 20 bp, Artificial Sequence
  Description of Artificial Sequence: Synthetic oligonucleotide
  Target: AGXT; (-) strand; PAM type: NRG; PAM sequence: GGG
gagatcccgcatcagaggcc

SEQ ID NO: 9217 - DNA, 20 bp, Artificial Sequence
  Description of Artificial Sequence: Synthetic oligonucleotide
  Target: AGXT; (-) strand; PAM type: NRG; PAM sequence: CGG
tgagatcccgcatcagaggc

SEQ ID NO: 9218 - DNA, 20 bp, Artificial Sequence
  Description of Artificial Sequence: Synthetic oligonucleotide
  Target: AGXT; (-) strand; PAM type: NRG; PAM sequence: AGG
gtcctgagatcccgcatcag

SEQ ID NO: 9219 - DNA, 20 bp, Artificial Sequence
  Description of Artificial Sequence: Synthetic oligonucleotide
  Target: AGXT; (-) strand; PAM type: NRG; PAM sequence: GAG
cgtcctgagatcccgcatca

SEQ ID NO: 9220 - DNA, 20 bp, Artificial Sequence
  Description of Artificial Sequence: Synthetic oligonucleotide
  Target: AGXT; (-) strand; PAM type: NRG; PAM sequence: CAG
gccgtcctgagatcccgcat

SEQ ID NO: 9221 - DNA, 20 bp, Artificial Sequence
  Description of Artificial Sequence: Synthetic oligonucleotide
  Target: AGXT; (-) strand; PAM type: NRG; PAM sequence: GAG
gggagatcacaggccgtcct

SEQ ID NO: 9222 - DNA, 20 bp, Artificial Sequence
  Description of Artificial Sequence: Synthetic oligonucleotide
  Target: AGXT; (-) strand; PAM type: NRG; PAM sequence: AGG
ccttcccactgggagatcac

SEQ ID NO: 9223 - DNA, 20 bp, Artificial Sequence
  Description of Artificial Sequence: Synthetic oligonucleotide
  Target: AGXT; (-) strand; PAM type: NRG; PAM sequence: CAG
accttcccactgggagatca

SEQ ID NO: 9224 - DNA, 20 bp, Artificial Sequence
  Description of Artificial Sequence: Synthetic oligonucleotide
  Target: AGXT; (-) strand; PAM type: NRG; PAM sequence: GAG
gatgggcaccttcccactgg

SEQ ID NO: 9225 - DNA, 20 bp, Artificial Sequence
  Description of Artificial Sequence: Synthetic oligonucleotide
  Target: AGXT; (-) strand; PAM type: NRG; PAM sequence: GGG
tggatgggcaccttcccact

SEQ ID NO: 9226 - DNA, 20 bp, Artificial Sequence
  Description of Artificial Sequence: Synthetic oligonucleotide
  Target: AGXT; (-) strand; PAM type: NRG; PAM sequence: TGG
gtggatgggcaccttcccac

SEQ ID NO: 9227 - DNA, 20 bp, Artificial Sequence
  Description of Artificial Sequence: Synthetic oligonucleotide
  Target: AGXT; (-) strand; PAM type: NRG; PAM sequence: GGG
ccccttaggaggcggtggat

SEQ ID NO: 9228 - DNA, 20 bp, Artificial Sequence
  Description of Artificial Sequence: Synthetic oligonucleotide
  Target: AGXT; (-) strand; PAM type: NRG; PAM sequence: TGG
accccttaggaggcggtgga

SEQ ID NO: 9229 - DNA, 20 bp, Artificial Sequence
  Description of Artificial Sequence: Synthetic oligonucleotide
  Target: AGXT; (-) strand; PAM type: NRG; PAM sequence: TGG
ccccaccccttaggaggcgg

SEQ ID NO: 9230 - DNA, 20 bp, Artificial Sequence
  Description of Artificial Sequence: Synthetic oligonucleotide
  Target: AGXT; (-) strand; PAM type: NRG; PAM sequence: CGG
ggaccccaccccttaggagg

SEQ ID NO: 9231 - DNA, 20 bp, Artificial Sequence
  Description of Artificial Sequence: Synthetic oligonucleotide
  Target: AGXT; (-) strand; PAM type: NRG; PAM sequence: AGG
cagggaccccaccccttagg

SEQ ID NO: 9232 - DNA, 20 bp, Artificial Sequence
  Description of Artificial Sequence: Synthetic oligonucleotide
  Target: AGXT; (-) strand; PAM type: NRG; PAM sequence: GAG
gcagggaccccaccccttag

SEQ ID NO: 9233 - DNA, 20 bp, Artificial Sequence
  Description of Artificial Sequence: Synthetic oligonucleotide
  Target: AGXT; (-) strand; PAM type: NRG; PAM sequence: AGG
gagcagggaccccacccctt

SEQ ID NO: 9234 - DNA, 20 bp, Artificial Sequence
  Description of Artificial Sequence: Synthetic oligonucleotide
  Target: AGXT; (-) strand; PAM type: NRG; PAM sequence: TAG
agagcagggaccccacccct

SEQ ID NO: 9235 - DNA, 20 bp, Artificial Sequence
  Description of Artificial Sequence: Synthetic oligonucleotide
  Target: AGXT; (-) strand; PAM type: NRG; PAM sequence: GGG
gaaagggccgggagagagca

SEQ ID NO: 9236 - DNA, 20 bp, Artificial Sequence
  Description of Artificial Sequence: Synthetic oligonucleotide
  Target: AGXT; (-) strand; PAM type: NRG; PAM sequence: AGG
agaaagggccgggagagagc

SEQ ID NO: 9237 - DNA, 20 bp, Artificial Sequence
  Description of Artificial Sequence: Synthetic oligonucleotide
  Target: AGXT; (-) strand; PAM type: NRG; PAM sequence: CAG
gagaaagggccgggagagag

SEQ ID NO: 9238 - DNA, 20 bp, Artificial Sequence
  Description of Artificial Sequence: Synthetic oligonucleotide
  Target: AGXT; (-) strand; PAM type: NRG; PAM sequence: GAG
ggggagaaagggccgggaga

SEQ ID NO: 9239 - DNA, 20 bp, Artificial Sequence
  Description of Artificial Sequence: Synthetic oligonucleotide
  Target: AGXT; (-) strand; PAM type: NRG; PAM sequence: GAG
cgggggagaaagggccggga

SEQ ID NO: 9240 - DNA, 20 bp, Artificial Sequence
  Description of Artificial Sequence: Synthetic oligonucleotide
  Target: AGXT; (-) strand; PAM type: NRG; PAM sequence: GAG
gccgggggagaaagggccgg

SEQ ID NO: 9241 - DNA, 20 bp, Artificial Sequence
  Description of Artificial Sequence: Synthetic oligonucleotide
  Target: AGXT; (-) strand; PAM type: NRG; PAM sequence: GGG
gagccgggggagaaagggcc

SEQ ID NO: 9242 - DNA, 20 bp, Artificial Sequence
  Description of Artificial Sequence: Synthetic oligonucleotide
  Target: AGXT; (-) strand; PAM type: NRG; PAM sequence: CGG
ggagccgggggagaaagggc

SEQ ID NO: 9243 - DNA, 20 bp, Artificial Sequence
  Description of Artificial Sequence: Synthetic oligonucleotide
  Target: AGXT; (-) strand; PAM type: NRG; PAM sequence: GGG
cagaggagccgggggagaaa

SEQ ID NO: 9244 - DNA, 20 bp, Artificial Sequence
  Description of Artificial Sequence: Synthetic oligonucleotide
  Target: AGXT; (-) strand; PAM type: NRG; PAM sequence: AGG
ccagaggagccgggggagaa

SEQ ID NO: 9245 - DNA, 20 bp, Artificial Sequence
  Description of Artificial Sequence: Synthetic oligonucleotide
  Target: AGXT; (-) strand; PAM type: NRG; PAM sequence: AAG
tccagaggagccgggggaga

SEQ ID NO: 9246 - DNA, 20 bp, Artificial Sequence
  Description of Artificial Sequence: Synthetic oligonucleotide
  Target: AGXT; (-) strand; PAM type: NRG; PAM sequence: GAG
aggttccagaggagccgggg

SEQ ID NO: 9247 - DNA, 20 bp, Artificial Sequence
  Description of Artificial Sequence: Synthetic oligonucleotide
  Target: AGXT; (-) strand; PAM type: NRG; PAM sequence: GGG
tcaggttccagaggagccgg

SEQ ID NO: 9248 - DNA, 20 bp, Artificial Sequence
  Description of Artificial Sequence: Synthetic oligonucleotide
  Target: AGXT; (-) strand; PAM type: NRG; PAM sequence: GGG
ttcaggttccagaggagccg

SEQ ID NO: 9249 - DNA, 20 bp, Artificial Sequence
  Description of Artificial Sequence: Synthetic oligonucleotide
  Target: AGXT; (-) strand; PAM type: NRG; PAM sequence: GGG
cttcaggttccagaggagcc

SEQ ID NO: 9250 - DNA, 20 bp, Artificial Sequence
  Description of Artificial Sequence: Synthetic oligonucleotide
  Target: AGXT; (-) strand; PAM type: NRG; PAM sequence: CGG
gcttcaggttccagaggagc

SEQ ID NO: 9251 - DNA, 20 bp, Artificial Sequence
  Description of Artificial Sequence: Synthetic oligonucleotide
  Target: AGXT; (-) strand; PAM type: NRG; PAM sequence: GAG
cccagcttcaggttccagag

SEQ ID NO: 9252 - DNA, 20 bp, Artificial Sequence
  Description of Artificial Sequence: Synthetic oligonucleotide
  Target: AGXT; (-) strand; PAM type: NRG; PAM sequence: AGG
gccccagcttcaggttccag

SEQ ID NO: 9253 - DNA, 20 bp, Artificial Sequence
  Description of Artificial Sequence: Synthetic oligonucleotide
  Target: AGXT; (-) strand; PAM type: NRG; PAM sequence: GAG
tgccccagcttcaggttcca

SEQ ID NO: 9254 - DNA, 20 bp, Artificial Sequence
  Description of Artificial Sequence: Synthetic oligonucleotide
  Target: AGXT; (-) strand; PAM type: NRG; PAM sequence: CAG
tctgccccagcttcaggttc

SEQ ID NO: 9255 - DNA, 20 bp, Artificial Sequence
  Description of Artificial Sequence: Synthetic oligonucleotide
  Target: AGXT; (-) strand; PAM type: NRG; PAM sequence: AGG
gcaccatctgccccagcttc

SEQ ID NO: 9256 - DNA, 20 bp, Artificial Sequence
  Description of Artificial Sequence: Synthetic oligonucleotide
  Target: AGXT; (-) strand; PAM type: NRG; PAM sequence: CAG
tgcaccatctgccccagctt

SEQ ID NO: 9257 - DNA, 20 bp, Artificial Sequence
  Description of Artificial Sequence: Synthetic oligonucleotide
  Target: AGXT; (-) strand; PAM type: NRG; PAM sequence: CAG
ttggcctgcaccatctgccc

SEQ ID NO: 9258 - DNA, 20 bp, Artificial Sequence
  Description of Artificial Sequence: Synthetic oligonucleotide
  Target: AGXT; (-) strand; PAM type: NRG; PAM sequence: TGG
cgggcctttgtgacagctct

SEQ ID NO: 9259 - DNA, 20 bp, Artificial Sequence
  Description of Artificial Sequence: Synthetic oligonucleotide
  Target: AGXT; (-) strand; PAM type: NRG; PAM sequence: CAG
ccctgtacgggcctttgtga

SEQ ID NO: 9260 - DNA, 20 bp, Artificial Sequence
  Description of Artificial Sequence: Synthetic oligonucleotide
  Target: AGXT; (-) strand; PAM type: NRG; PAM sequence: GGG
gtgggtgagaggccctgtac

SEQ ID NO: 9261 - DNA, 20 bp, Artificial Sequence
  Description of Artificial Sequence: Synthetic oligonucleotide
  Target: AGXT; (-) strand; PAM type: NRG; PAM sequence: CGG
cgtgggtgagaggccctgta

SEQ ID NO: 9262 - DNA, 20 bp, Artificial Sequence
  Description of Artificial Sequence: Synthetic oligonucleotide
  Target: AGXT; (-) strand; PAM type: NRG; PAM sequence: AGG
tggctcagtgcgtgggtgag

SEQ ID NO: 9263 - DNA, 20 bp, Artificial Sequence
  Description of Artificial Sequence: Synthetic oligonucleotide
  Target: AGXT; (-) strand; PAM type: NRG; PAM sequence: GAG
ctggctcagtgcgtgggtga

SEQ ID NO: 9264 - DNA, 20 bp, Artificial Sequence
  Description of Artificial Sequence: Synthetic oligonucleotide
  Target: AGXT; (-) strand; PAM type: NRG; PAM sequence: GAG
gcctggctcagtgcgtgggt

SEQ ID NO: 9265 - DNA, 20 bp, Artificial Sequence
  Description of Artificial Sequence: Synthetic oligonucleotide
  Target: AGXT; (-) strand; PAM type: NRG; PAM sequence: GGG
aggggcctggctcagtgcgt

SEQ ID NO: 9266 - DNA, 20 bp, Artificial Sequence
  Description of Artificial Sequence: Synthetic oligonucleotide
  Target: AGXT; (-) strand; PAM type: NRG; PAM sequence: TGG
gaggggcctggctcagtgcg

SEQ ID NO: 9267 - DNA, 20 bp, Artificial Sequence
  Description of Artificial Sequence: Synthetic oligonucleotide
  Target: AGXT; (-) strand; PAM type: NRG; PAM sequence: CAG
cctgcaggaggggcctggct

SEQ ID NO: 9268 - DNA, 20 bp, Artificial Sequence
  Description of Artificial Sequence: Synthetic oligonucleotide
  Target: AGXT; (-) strand; PAM type: NRG; PAM sequence: TGG
gagcgcctgcaggaggggcc

SEQ ID NO: 9269 - DNA, 20 bp, Artificial Sequence
  Description of Artificial Sequence: Synthetic oligonucleotide
  Target: AGXT; (-) strand; PAM type: NRG; PAM sequence: GGG
agccggagcgcctgcaggag

SEQ ID NO: 9270 - DNA, 20 bp, Artificial Sequence
  Description of Artificial Sequence: Synthetic oligonucleotide
  Target: AGXT; (-) strand; PAM type: NRG; PAM sequence: GGG
aagccggagcgcctgcagga

SEQ ID NO: 9271 - DNA, 20 bp, Artificial Sequence
  Description of Artificial Sequence: Synthetic oligonucleotide
  Target: AGXT; (-) strand; PAM type: NRG; PAM sequence: AGG
gaagccggagcgcctgcagg

SEQ ID NO: 9272 - DNA, 20 bp, Artificial Sequence
  Description of Artificial Sequence: Synthetic oligonucleotide
  Target: AGXT; (-) strand; PAM type: NRG; PAM sequence: GAG
ggaagccggagcgcctgcag

SEQ ID NO: 9273 - DNA, 20 bp, Artificial Sequence
  Description of Artificial Sequence: Synthetic oligonucleotide
  Target: AGXT; (-) strand; PAM type: NRG; PAM sequence: AGG
tgggaagccggagcgcctgc

SEQ ID NO: 9274 - DNA, 20 bp, Artificial Sequence
  Description of Artificial Sequence: Synthetic oligonucleotide
  Target: AGXT; (-) strand; PAM type: NRG; PAM sequence: CAG
gtgggaagccggagcgcctg

SEQ ID NO: 9275 - DNA, 20 bp, Artificial Sequence
  Description of Artificial Sequence: Synthetic oligonucleotide
  Target: AGXT; (-) strand; PAM type: NRG; PAM sequence: GAG
gtggtgactgtgggaagccg

SEQ ID NO: 9276 - DNA, 20 bp, Artificial Sequence
  Description of Artificial Sequence: Synthetic oligonucleotide
  Target: AGXT; (-) strand; PAM type: NRG; PAM sequence: CGG
cagtggtgactgtgggaagc

SEQ ID NO: 9277 - DNA, 20 bp, Artificial Sequence
  Description of Artificial Sequence: Synthetic oligonucleotide
  Target: AGXT; (-) strand; PAM type: NRG; PAM sequence: AAG
gccacagtggtgactgtggg

SEQ ID NO: 9278 - DNA, 20 bp, Artificial Sequence
  Description of Artificial Sequence: Synthetic oligonucleotide
  Target: AGXT; (-) strand; PAM type: NRG; PAM sequence: GGG
acagccacagtggtgactgt

SEQ ID NO: 9279 - DNA, 20 bp, Artificial Sequence
  Description of Artificial Sequence: Synthetic oligonucleotide
  Target: AGXT; (-) strand; PAM type: NRG; PAM sequence: TGG
tacagccacagtggtgactg

SEQ ID NO: 9280 - DNA, 20 bp, Artificial Sequence
  Description of Artificial Sequence: Synthetic oligonucleotide
  Target: AGXT; (-) strand; PAM type: NRG; PAM sequence: TGG
gccagcgggtacagccacag

SEQ ID NO: 9281 - DNA, 20 bp, Artificial Sequence
  Description of Artificial Sequence: Synthetic oligonucleotide
  Target: AGXT; (-) strand; PAM type: NRG; PAM sequence: CAG
atagccagcgggtacagcca

SEQ ID NO: 9282 - DNA, 20 bp, Artificial Sequence
  Description of Artificial Sequence: Synthetic oligonucleotide
  Target: AGXT; (-) strand; PAM type: NRG; PAM sequence: CAG
ccagtcatagccagcgggta

SEQ ID NO: 9283 - DNA, 20 bp, Artificial Sequence
  Description of Artificial Sequence: Synthetic oligonucleotide
  Target: AGXT; (-) strand; PAM type: NRG; PAM sequence: GGG
tctctccagtcatagccagc

SEQ ID NO: 9284 - DNA, 20 bp, Artificial Sequence
  Description of Artificial Sequence: Synthetic oligonucleotide
  Target: AGXT; (-) strand; PAM type: NRG; PAM sequence: CGG
gtctctccagtcatagccag

SEQ ID NO: 9285 - DNA, 20 bp, Artificial Sequence
  Description of Artificial Sequence: Synthetic oligonucleotide
  Target: AGXT; (-) strand; PAM type: NRG; PAM sequence: CAG
gatgtctctccagtcatagc

SEQ ID NO: 9286 - DNA, 20 bp, Artificial Sequence
  Description of Artificial Sequence: Synthetic oligonucleotide
  Target: AGXT; (-) strand; PAM type: NRG; PAM sequence: TAG
tgacgatgtctctccagtca

SEQ ID NO: 9287 - DNA, 20 bp, Artificial Sequence
  Description of Artificial Sequence: Synthetic oligonucleotide
  Target: AGXT; (-) strand; PAM type: NRG; PAM sequence: CAG
cgtagctgacgatgtctctc

SEQ ID NO: 9288 - DNA, 20 bp, Artificial Sequence
  Description of Artificial Sequence: Synthetic oligonucleotide
  Target: AGXT; (-) strand; PAM type: NRG; PAM sequence: TAG
tgtcgaagtggtctatgacg

SEQ ID NO: 9289 - DNA, 20 bp, Artificial Sequence
  Description of Artificial Sequence: Synthetic oligonucleotide
  Target: AGXT; (-) strand; PAM type: NRG; PAM sequence: TGG
ccatgatctcaatgtcgaag

SEQ ID NO: 9290 - DNA, 20 bp, Artificial Sequence
  Description of Artificial Sequence: Synthetic oligonucleotide
  Target: AGXT; (-) strand; PAM type: NRG; PAM sequence: AAG
cacccatgatctcaatgtcg

SEQ ID NO: 9291 - DNA, 20 bp, Artificial Sequence
  Description of Artificial Sequence: Synthetic oligonucleotide
  Target: AGXT; (-) strand; PAM type: NRG; PAM sequence: AGG
ccttccccgtggagggccca

SEQ ID NO: 9292 - DNA, 20 bp, Artificial Sequence
  Description of Artificial Sequence: Synthetic oligonucleotide
  Target: AGXT; (-) strand; PAM type: NRG; PAM sequence: AAG
accttccccgtggagggccc

SEQ ID NO: 9293 - DNA, 20 bp, Artificial Sequence
  Description of Artificial Sequence: Synthetic oligonucleotide
  Target: AGXT; (-) strand; PAM type: NRG; PAM sequence: GGG
cctctcaccttccccgtgga

SEQ ID NO: 9294 - DNA, 20 bp, Artificial Sequence
  Description of Artificial Sequence: Synthetic oligonucleotide
  Target: AGXT; (-) strand; PAM type: NRG; PAM sequence: AGG
ccctctcaccttccccgtgg

SEQ ID NO: 9295 - DNA, 20 bp, Artificial Sequence
  Description of Artificial Sequence: Synthetic oligonucleotide
  Target: AGXT; (-) strand; PAM type: NRG; PAM sequence: GAG
tccctctcaccttccccgtg

SEQ ID NO: 9296 - DNA, 20 bp, Artificial Sequence
  Description of Artificial Sequence: Synthetic oligonucleotide
  Target: AGXT; (-) strand; PAM type: NRG; PAM sequence: TGG
gctccctctcaccttccccg

SEQ ID NO: 9297 - DNA, 20 bp, Artificial Sequence
  Description of Artificial Sequence: Synthetic oligonucleotide
  Target: AGXT; (-) strand; PAM type: NRG; PAM sequence: AGG
gtttctgcaaaaggccctcg

SEQ ID NO: 9298 - DNA, 20 bp, Artificial Sequence
  Description of Artificial Sequence: Synthetic oligonucleotide
  Target: AGXT; (-) strand; PAM type: NRG; PAM sequence: GAG
ggtttctgcaaaaggccctc

SEQ ID NO: 9299 - DNA, 20 bp, Artificial Sequence
  Description of Artificial Sequence: Synthetic oligonucleotide
  Target: AGXT; (-) strand; PAM type: NRG; PAM sequence: AGG
gcgggtttggtttctgcaaa

SEQ ID NO: 9300 - DNA, 20 bp, Artificial Sequence
  Description of Artificial Sequence: Synthetic oligonucleotide
  Target: AGXT; (-) strand; PAM type: NRG; PAM sequence: AAG
ggcgggtttggtttctgcaa

SEQ ID NO: 9301 - DNA, 20 bp, Artificial Sequence
  Description of Artificial Sequence: Synthetic oligonucleotide
  Target: AGXT; (-) strand; PAM type: NRG; PAM sequence: TGG
tcaaggaggggtggcgggtt

SEQ ID NO: 9302 - DNA, 20 bp, Artificial Sequence
  Description of Artificial Sequence: Synthetic oligonucleotide
  Target: AGXT; (-) strand; PAM type: NRG; PAM sequence: GGG
cctgctcaaggaggggtggc

SEQ ID NO: 9303 - DNA, 20 bp, Artificial Sequence
  Description of Artificial Sequence: Synthetic oligonucleotide
  Target: AGXT; (-) strand; PAM type: NRG; PAM sequence: CGG
tcctgctcaaggaggggtgg

SEQ ID NO: 9304 - DNA, 20 bp, Artificial Sequence
  Description of Artificial Sequence: Synthetic oligonucleotide
  Target: AGXT; (-) strand; PAM type: NRG; PAM sequence: TGG
cagtcctgctcaaggagggg

SEQ ID NO: 9305 - DNA, 20 bp, Artificial Sequence
  Description of Artificial Sequence: Synthetic oligonucleotide
  Target: AGXT; (-) strand; PAM type: NRG; PAM sequence: GGG
gcacagtcctgctcaaggag

SEQ ID NO: 9306 - DNA, 20 bp, Artificial Sequence
  Description of Artificial Sequence: Synthetic oligonucleotide
  Target: AGXT; (-) strand; PAM type: NRG; PAM sequence: GGG
tgcacagtcctgctcaagga

SEQ ID NO: 9307 - DNA, 20 bp, Artificial Sequence
  Description of Artificial Sequence: Synthetic oligonucleotide
  Target: AGXT; (-) strand; PAM type: NRG; PAM sequence: AGG
gtgcacagtcctgctcaagg

SEQ ID NO: 9308 - DNA, 20 bp, Artificial Sequence
  Description of Artificial Sequence: Synthetic oligonucleotide
  Target: AGXT; (-) strand; PAM type: NRG; PAM sequence: GAG
ggtgcacagtcctgctcaag

SEQ ID NO: 9309 - DNA, 20 bp, Artificial Sequence
  Description of Artificial Sequence: Synthetic oligonucleotide
  Target: AGXT; (-) strand; PAM type: NRG; PAM sequence: AGG
ctggtgcacagtcctgctca

SEQ ID NO: 9310 - DNA, 20 bp, Artificial Sequence
  Description of Artificial Sequence: Synthetic oligonucleotide
  Target: AGXT; (-) strand; PAM type: NRG; PAM sequence: AAG
cctggtgcacagtcctgctc

SEQ ID NO: 9311 - DNA, 20 bp, Artificial Sequence
  Description of Artificial Sequence: Synthetic oligonucleotide
  Target: AGXT; (-) strand; PAM type: NRG; PAM sequence: CAG
cctcccctgcacctggtgca

SEQ ID NO: 9312 - DNA, 20 bp, Artificial Sequence
  Description of Artificial Sequence: Synthetic oligonucleotide
  Target: AGXT; (-) strand; PAM type: NRG; PAM sequence: TGG
accccggcctcccctgcacc

SEQ ID NO: 9313 - DNA, 20 bp, Artificial Sequence
  Description of Artificial Sequence: Synthetic oligonucleotide
  Target: AGXT; (-) strand; PAM type: NRG; PAM sequence: CGG
tctgggctttcggatgaccc

SEQ ID NO: 9314 - DNA, 20 bp, Artificial Sequence
  Description of Artificial Sequence: Synthetic oligonucleotide
  Target: AGXT; (-) strand; PAM type: NRG; PAM sequence: CGG
gctcctgcaatctgggcttt

SEQ ID NO: 9315 - DNA, 20 bp, Artificial Sequence
  Description of Artificial Sequence: Synthetic oligonucleotide
  Target: AGXT; (-) strand; PAM type: NRG; PAM sequence: GGG
tctggacgctcctgcaatct

SEQ ID NO: 9316 - DNA, 20 bp, Artificial Sequence
  Description of Artificial Sequence: Synthetic oligonucleotide
  Target: AGXT; (-) strand; PAM type: NRG; PAM sequence: TGG
ttctggacgctcctgcaatc

SEQ ID NO: 9317 - DNA, 20 bp, Artificial Sequence
  Description of Artificial Sequence: Synthetic oligonucleotide
  Target: AGXT; (-) strand; PAM type: NRG; PAM sequence: TGG
ccttggagagtgggcccttc

SEQ ID NO: 9318 - DNA, 20 bp, Artificial Sequence
  Description of Artificial Sequence: Synthetic oligonucleotide
  Target: AGXT; (-) strand; PAM type: NRG; PAM sequence: GGG
ctggataccccttggagagt

SEQ ID NO: 9319 - DNA, 20 bp, Artificial Sequence
  Description of Artificial Sequence: Synthetic oligonucleotide
  Target: AGXT; (-) strand; PAM type: NRG; PAM sequence: TGG
actggataccccttggagag

SEQ ID NO: 9320 - DNA, 20 bp, Artificial Sequence
  Description of Artificial Sequence: Synthetic oligonucleotide
  Target: AGXT; (-) strand; PAM type: NRG; PAM sequence: GAG
tttactggataccccttgga

SEQ ID NO: 9321 - DNA, 20 bp, Artificial Sequence
  Description of Artificial Sequence: Synthetic oligonucleotide
  Target: AGXT; (-) strand; PAM type: NRG; PAM sequence: GAG
gctttactggataccccttg

SEQ ID NO: 9322 - DNA, 20 bp, Artificial Sequence
  Description of Artificial Sequence: Synthetic oligonucleotide
  Target: AGXT; (-) strand; PAM type: NRG; PAM sequence: TGG
acgctttactggatacccct

SEQ ID NO: 9323 - DNA, 20 bp, Artificial Sequence
  Description of Artificial Sequence: Synthetic oligonucleotide
  Target: AGXT; (-) strand; PAM type: NRG; PAM sequence: TGG
ggcgacaggatacgctttac

SEQ ID NO: 9324 - DNA, 20 bp, Artificial Sequence
  Description of Artificial Sequence: Synthetic oligonucleotide
  Target: AGXT; (-) strand; PAM type: NRG; PAM sequence: AGG
ggggtgggagcaggggcgac

SEQ ID NO: 9325 - DNA, 20 bp, Artificial Sequence
  Description of Artificial Sequence: Synthetic oligonucleotide
  Target: AGXT; (-) strand; PAM type: NRG; PAM sequence: CAG
tggggtgggagcaggggcga

SEQ ID NO: 9326 - DNA, 20 bp, Artificial Sequence
  Description of Artificial Sequence: Synthetic oligonucleotide
  Target: AGXT; (-) strand; PAM type: NRG; PAM sequence: GGG
gtgggctggggtgggagcag

SEQ ID NO: 9327 - DNA, 20 bp, Artificial Sequence
  Description of Artificial Sequence: Synthetic oligonucleotide
  Target: AGXT; (-) strand; PAM type: NRG; PAM sequence: GGG
agtgggctggggtgggagca

SEQ ID NO: 9328 - DNA, 20 bp, Artificial Sequence
  Description of Artificial Sequence: Synthetic oligonucleotide
  Target: AGXT; (-) strand; PAM type: NRG; PAM sequence: AGG
cagtgggctggggtgggagc

SEQ ID NO: 9329 - DNA, 20 bp, Artificial Sequence
  Description of Artificial Sequence: Synthetic oligonucleotide
  Target: AGXT; (-) strand; PAM type: NRG; PAM sequence: CAG
tcagtgggctggggtgggag

SEQ ID NO: 9330 - DNA, 20 bp, Artificial Sequence
  Description of Artificial Sequence: Synthetic oligonucleotide
  Target: AGXT; (-) strand; PAM type: NRG; PAM sequence: GAG
acctcagtgggctggggtgg

SEQ ID NO: 9331 - DNA, 20 bp, Artificial Sequence
  Description of Artificial Sequence: Synthetic oligonucleotide
  Target: AGXT; (-) strand; PAM type: NRG; PAM sequence: GGG
tgacctcagtgggctggggt

SEQ ID NO: 9332 - DNA, 20 bp, Artificial Sequence
  Description of Artificial Sequence: Synthetic oligonucleotide
  Target: AGXT; (-) strand; PAM type: NRG; PAM sequence: TGG
gtgacctcagtgggctgggg

SEQ ID NO: 9333 - DNA, 20 bp, Artificial Sequence
  Description of Artificial Sequence: Synthetic oligonucleotide
  Target: AGXT; (-) strand; PAM type: NRG; PAM sequence: GGG
ctggtgacctcagtgggctg

SEQ ID NO: 9334 - DNA, 20 bp, Artificial Sequence
  Description of Artificial Sequence: Synthetic oligonucleotide
  Target: AGXT; (-) strand; PAM type: NRG; PAM sequence: GGG
cctggtgacctcagtgggct

SEQ ID NO: 9335 - DNA, 20 bp, Artificial Sequence
  Description of Artificial Sequence: Synthetic oligonucleotide
  Target: AGXT; (-) strand; PAM type: NRG; PAM sequence: TGG
acctggtgacctcagtgggc

SEQ ID NO: 9336 - DNA, 20 bp, Artificial Sequence
  Description of Artificial Sequence: Synthetic oligonucleotide
  Target: AGXT; (-) strand; PAM type: NRG; PAM sequence: GGG
ctgcacctggtgacctcagt

SEQ ID NO: 9337 - DNA, 20 bp, Artificial Sequence
  Description of Artificial Sequence: Synthetic oligonucleotide
  Target: AGXT; (-) strand; PAM type: NRG; PAM sequence: TGG
gctgcacctggtgacctcag

SEQ ID NO: 9338 - DNA, 20 bp, Artificial Sequence
  Description of Artificial Sequence: Synthetic oligonucleotide
  Target: AGXT; (-) strand; PAM type: NRG; PAM sequence: CAG
aaggctgcacctggtgacct

SEQ ID NO: 9339 - DNA, 20 bp, Artificial Sequence
  Description of Artificial Sequence: Synthetic oligonucleotide
  Target: AGXT; (-) strand; PAM type: NRG; PAM sequence: TGG
ggaatcataaaggctgcacc

SEQ ID NO: 9340 - DNA, 20 bp, Artificial Sequence
  Description of Artificial Sequence: Synthetic oligonucleotide
  Target: AGXT; (-) strand; PAM type: NRG; PAM sequence: AGG
tgttccgagtggaatcataa

SEQ ID NO: 9341 - DNA, 20 bp, Artificial Sequence
  Description of Artificial Sequence: Synthetic oligonucleotide
  Target: AGXT; (-) strand; PAM type: NRG; PAM sequence: AAG
atgttccgagtggaatcata

SEQ ID NO: 9342 - DNA, 20 bp, Artificial Sequence
  Description of Artificial Sequence: Synthetic oligonucleotide
  Target: AGXT; (-) strand; PAM type: NRG; PAM sequence: TGG
ggaaggaaggatgttccgag

SEQ ID NO: 9343 - DNA, 20 bp, Artificial Sequence
  Description of Artificial Sequence: Synthetic oligonucleotide
  Target: AGXT; (-) strand; PAM type: NRG; PAM sequence: GAG
gagggaaggaaggatgttcc

SEQ ID NO: 9344 - DNA, 20 bp, Artificial Sequence
  Description of Artificial Sequence: Synthetic oligonucleotide
  Target: AGXT; (-) strand; PAM type: NRG; PAM sequence: AGG
ggtctggtcagagggaagga

SEQ ID NO: 9345 - DNA, 20 bp, Artificial Sequence
  Description of Artificial Sequence: Synthetic oligonucleotide
  Target: AGXT; (-) strand; PAM type: NRG; PAM sequence: AAG
gggtctggtcagagggaagg

SEQ ID NO: 9346 - DNA, 20 bp, Artificial Sequence
  Description of Artificial Sequence: Synthetic oligonucleotide
  Target: AGXT; (-) strand; PAM type: NRG; PAM sequence: AGG
ccagggtctggtcagaggga

SEQ ID NO: 9347 - DNA, 20 bp, Artificial Sequence
  Description of Artificial Sequence: Synthetic oligonucleotide
  Target: AGXT; (-) strand; PAM type: NRG; PAM sequence: AAG
tccagggtctggtcagaggg

SEQ ID NO: 9348 - DNA, 20 bp, Artificial Sequence
  Description of Artificial Sequence: Synthetic oligonucleotide
  Target: AGXT; (-) strand; PAM type: NRG; PAM sequence: GGG
ggttccagggtctggtcaga

SEQ ID NO: 9349 - DNA, 20 bp, Artificial Sequence
  Description of Artificial Sequence: Synthetic oligonucleotide
  Target: AGXT; (-) strand; PAM type: NRG; PAM sequence: AGG
tggttccagggtctggtcag

SEQ ID NO: 9350 - DNA, 20 bp, Artificial Sequence
  Description of Artificial Sequence: Synthetic oligonucleotide
  Target: AGXT; (-) strand; PAM type: NRG; PAM sequence: GAG
ctggttccagggtctggtca

SEQ ID NO: 9351 - DNA, 20 bp, Artificial Sequence
  Description of Artificial Sequence: Synthetic oligonucleotide
  Target: AGXT; (-) strand; PAM type: NRG; PAM sequence: CAG
gcctggttccagggtctggt

SEQ ID NO: 9352 - DNA, 20 bp, Artificial Sequence
  Description of Artificial Sequence: Synthetic oligonucleotide
  Target: AGXT; (-) strand; PAM type: NRG; PAM sequence: TGG
tccggcctggttccagggtc

SEQ ID NO: 9353 - DNA, 20 bp, Artificial Sequence
  Description of Artificial Sequence: Synthetic oligonucleotide
  Target: AGXT; (-) strand; PAM type: NRG; PAM sequence: GGG
gggcttccggcctggttcca

SEQ ID NO: 9354 - DNA, 20 bp, Artificial Sequence
  Description of Artificial Sequence: Synthetic oligonucleotide
  Target: AGXT; (-) strand; PAM type: NRG; PAM sequence: AGG
ggggcttccggcctggttcc

SEQ ID NO: 9355 - DNA, 20 bp, Artificial Sequence
  Description of Artificial Sequence: Synthetic oligonucleotide
  Target: AGXT; (-) strand; PAM type: NRG; PAM sequence: CAG
tggggcttccggcctggttc

SEQ ID NO: 9356 - DNA, 20 bp, Artificial Sequence
  Description of Artificial Sequence: Synthetic oligonucleotide
  Target: AGXT; (-) strand; PAM type: NRG; PAM sequence: TGG
caggcgtggggcttccggcc

SEQ ID NO: 9357 - DNA, 20 bp, Artificial Sequence
  Description of Artificial Sequence: Synthetic oligonucleotide
  Target: AGXT; (-) strand; PAM type: NRG; PAM sequence: CGG
aggcccaggcgtggggcttc

SEQ ID NO: 9358 - DNA, 20 bp, Artificial Sequence
  Description of Artificial Sequence: Synthetic oligonucleotide
  Target: AGXT; (-) strand; PAM type: NRG; PAM sequence: GGG
cacagccaggcccaggcgtg

SEQ ID NO: 9359 - DNA, 20 bp, Artificial Sequence
  Description of Artificial Sequence: Synthetic oligonucleotide
  Target: AGXT; (-) strand; PAM type: NRG; PAM sequence: GGG
acacagccaggcccaggcgt

SEQ ID NO: 9360 - DNA, 20 bp, Artificial Sequence
  Description of Artificial Sequence: Synthetic oligonucleotide
  Target: AGXT; (-) strand; PAM type: NRG; PAM sequence: TGG
gacacagccaggcccaggcg

SEQ ID NO: 9361 - DNA, 20 bp, Artificial Sequence
  Description of Artificial Sequence: Synthetic oligonucleotide
  Target: AGXT; (-) strand; PAM type: NRG; PAM sequence: AGG
tcagagacacagccaggccc

SEQ ID NO: 9362 - DNA, 20 bp, Artificial Sequence
  Description of Artificial Sequence: Synthetic oligonucleotide
  Target: AGXT; (-) strand; PAM type: NRG; PAM sequence: CAG
ctcagagacacagccaggcc

SEQ ID NO: 9363 - DNA, 20 bp, Artificial Sequence
  Description of Artificial Sequence: Synthetic oligonucleotide
  Target: AGXT; (-) strand; PAM type: NRG; PAM sequence: AGG
tgccactcagagacacagcc

SEQ ID NO: 9364 - DNA, 20 bp, Artificial Sequence
  Description of Artificial Sequence: Synthetic oligonucleotide
  Target: AGXT; (-) strand; PAM type: NRG; PAM sequence: CAG
ctgccactcagagacacagc

SEQ ID NO: 9365 - DNA, 20 bp, Artificial Sequence
  Description of Artificial Sequence: Synthetic oligonucleotide
  Target: AGXT; (-) strand; PAM type: NRG; PAM sequence: CAG
cccactgccactcagagaca

SEQ ID NO: 9366 - DNA, 20 bp, Artificial Sequence
  Description of Artificial Sequence: Synthetic oligonucleotide
  Target: AGXT; (-) strand; PAM type: NRG; PAM sequence: GAG
tccctccccactgccactca

SEQ ID NO: 9367 - DNA, 20 bp, Artificial Sequence
  Description of Artificial Sequence: Synthetic oligonucleotide
  Target: AGXT; (-) strand; PAM type: NRG; PAM sequence: CAG
ggtccctccccactgccact

SEQ ID NO: 9368 - DNA, 20 bp, Artificial Sequence
  Description of Artificial Sequence: Synthetic oligonucleotide
  Target: AGXT; (-) strand; PAM type: NRG; PAM sequence: AGG
aggacagggtggtgcagtga

SEQ ID NO: 9369 - DNA, 20 bp, Artificial Sequence
  Description of Artificial Sequence: Synthetic oligonucleotide
  Target: AGXT; (-) strand; PAM type: NRG; PAM sequence: AAG
gaggacagggtggtgcagtg

SEQ ID NO: 9370 - DNA, 20 bp, Artificial Sequence
  Description of Artificial Sequence: Synthetic oligonucleotide
  Target: AGXT; (-) strand; PAM type: NRG; PAM sequence: CAG
cacgggaggacagggtggtg

SEQ ID NO: 9371 - DNA, 20 bp, Artificial Sequence
  Description of Artificial Sequence: Synthetic oligonucleotide
  Target: AGXT; (-) strand; PAM type: NRG; PAM sequence: TGG
agccacacgggaggacaggg

SEQ ID NO: 9372 - DNA, 20 bp, Artificial Sequence
  Description of Artificial Sequence: Synthetic oligonucleotide
  Target: AGXT; (-) strand; PAM type: NRG; PAM sequence: GGG
cgcagccacacgggaggaca

SEQ ID NO: 9373 - DNA, 20 bp, Artificial Sequence
  Description of Artificial Sequence: Synthetic oligonucleotide
  Target: AGXT; (-) strand; PAM type: NRG; PAM sequence: AGG
ccgcagccacacgggaggac

SEQ ID NO: 9374 - DNA, 20 bp, Artificial Sequence
  Description of Artificial Sequence: Synthetic oligonucleotide
  Target: AGXT; (-) strand; PAM type: NRG; PAM sequence: CAG
cccgcagccacacgggagga

SEQ ID NO: 9375 - DNA, 20 bp, Artificial Sequence
  Description of Artificial Sequence: Synthetic oligonucleotide
  Target: AGXT; (-) strand; PAM type: NRG; PAM sequence: AGG
tgcacccgcagccacacggg

SEQ ID NO: 9376 - DNA, 20 bp, Artificial Sequence
  Description of Artificial Sequence: Synthetic oligonucleotide
  Target: AGXT; (-) strand; PAM type: NRG; PAM sequence: GAG
ctgcacccgcagccacacgg

SEQ ID NO: 9377 - DNA, 20 bp, Artificial Sequence
  Description of Artificial Sequence: Synthetic oligonucleotide
  Target: AGXT; (-) strand; PAM type: NRG; PAM sequence: GGG
ctctgcacccgcagccacac

SEQ ID NO: 9378 - DNA, 20 bp, Artificial Sequence
  Description of Artificial Sequence: Synthetic oligonucleotide
  Target: AGXT; (-) strand; PAM type: NRG; PAM sequence: CGG
cctctgcacccgcagccaca

SEQ ID NO: 9379 - DNA, 20 bp, Artificial Sequence
  Description of Artificial Sequence: Synthetic oligonucleotide
  Target: AGXT; (-) strand; PAM type: NRG; PAM sequence: CAG
ctctcctccctctgcacccg

SEQ ID NO: 9380 - DNA, 20 bp, Artificial Sequence
  Description of Artificial Sequence: Synthetic oligonucleotide
  Target: AGXT; (-) strand; PAM type: NRG; PAM sequence: AGG
ttgagcacccaggccagggc

SEQ ID NO: 9381 - DNA, 20 bp, Artificial Sequence
  Description of Artificial Sequence: Synthetic oligonucleotide
  Target: AGXT; (-) strand; PAM type: NRG; PAM sequence: CAG
cttgagcacccaggccaggg

SEQ ID NO: 9382 - DNA, 20 bp, Artificial Sequence
  Description of Artificial Sequence: Synthetic oligonucleotide
  Target: AGXT; (-) strand; PAM type: NRG; PAM sequence: GGG
gcccttgagcacccaggcca

SEQ ID NO: 9383 - DNA, 20 bp, Artificial Sequence
  Description of Artificial Sequence: Synthetic oligonucleotide
  Target: AGXT; (-) strand; PAM type: NRG; PAM sequence: AGG
ggcccttgagcacccaggcc

SEQ ID NO: 9384 - DNA, 20 bp, Artificial Sequence
  Description of Artificial Sequence: Synthetic oligonucleotide
  Target: AGXT; (-) strand; PAM type: NRG; PAM sequence: CAG
gggcccttgagcacccaggc

SEQ ID NO: 9385 - DNA, 20 bp, Artificial Sequence
  Description of Artificial Sequence: Synthetic oligonucleotide
  Target: AGXT; (-) strand; PAM type: NRG; PAM sequence: AGG
gagggggcccttgagcaccc

SEQ ID NO: 9386 - DNA, 20 bp, Artificial Sequence
  Description of Artificial Sequence: Synthetic oligonucleotide
  Target: AGXT; (-) strand; PAM type: NRG; PAM sequence: CAG
agagggggcccttgagcacc

SEQ ID NO: 9387 - DNA, 20 bp, Artificial Sequence
  Description of Artificial Sequence: Synthetic oligonucleotide
  Target: AGXT; (-) strand; PAM type: NRG; PAM sequence: GAG
aggtcacagagggggccctt

SEQ ID NO: 9388 - DNA, 20 bp, Artificial Sequence
  Description of Artificial Sequence: Synthetic oligonucleotide
  Target: AGXT; (-) strand; PAM type: NRG; PAM sequence: GGG
ccctgtgcaggtcacagagg

SEQ ID NO: 9389 - DNA, 20 bp, Artificial Sequence
  Description of Artificial Sequence: Synthetic oligonucleotide
  Target: AGXT; (-) strand; PAM type: NRG; PAM sequence: GGG
gccctgtgcaggtcacagag

SEQ ID NO: 9390 - DNA, 20 bp, Artificial Sequence
  Description of Artificial Sequence: Synthetic oligonucleotide
  Target: AGXT; (-) strand; PAM type: NRG; PAM sequence: GGG
agccctgtgcaggtcacaga

SEQ ID NO: 9391 - DNA, 20 bp, Artificial Sequence
  Description of Artificial Sequence: Synthetic oligonucleotide
  Target: AGXT; (-) strand; PAM type: NRG; PAM sequence: AGG
cagccctgtgcaggtcacag

SEQ ID NO: 9392 - DNA, 20 bp, Artificial Sequence
  Description of Artificial Sequence: Synthetic oligonucleotide
  Target: AGXT; (-) strand; PAM type: NRG; PAM sequence: GAG
acagccctgtgcaggtcaca

SEQ ID NO: 9393 - DNA, 20 bp, Artificial Sequence
  Description of Artificial Sequence: Synthetic oligonucleotide
  Target: AGXT; (-) strand; PAM type: NRG; PAM sequence: CAG
tgacagccctgtgcaggtca

SEQ ID NO: 9394 - DNA, 20 bp, Artificial Sequence
  Description of Artificial Sequence: Synthetic oligonucleotide
  Target: AGXT; (-) strand; PAM type: NRG; PAM sequence: AGG
gggagttgacagccctgtgc

SEQ ID NO: 9395 - DNA, 20 bp, Artificial Sequence
  Description of Artificial Sequence: Synthetic oligonucleotide
  Target: AGXT; (-) strand; PAM type: NRG; PAM sequence: CAG
ggggagttgacagccctgtg

SEQ ID NO: 9396 - DNA, 20 bp, Artificial Sequence
  Description of Artificial Sequence: Synthetic oligonucleotide
  Target: AGXT; (-) strand; PAM type: NRG; PAM sequence: CAG
gcgtccatgaggggagttga

SEQ ID NO: 9397 - DNA, 20 bp, Artificial Sequence
  Description of Artificial Sequence: Synthetic oligonucleotide
  Target: AGXT; (-) strand; PAM type: NRG; PAM sequence: GAG
ccacccagcgtccatgaggg

SEQ ID NO: 9398 - DNA, 20 bp, Artificial Sequence
  Description of Artificial Sequence: Synthetic oligonucleotide
  Target: AGXT; (-) strand; PAM type: NRG; PAM sequence: GGG
acccacccagcgtccatgag

SEQ ID NO: 9399 - DNA, 20 bp, Artificial Sequence
  Description of Artificial Sequence: Synthetic oligonucleotide
  Target: AGXT; (-) strand; PAM type: NRG; PAM sequence: GGG
cacccacccagcgtccatga

SEQ ID NO: 9400 - DNA, 20 bp, Artificial Sequence
  Description of Artificial Sequence: Synthetic oligonucleotide
  Target: AGXT; (-) strand; PAM type: NRG; PAM sequence: AGG
ccacccacccagcgtccatg

SEQ ID NO: 9401 - DNA, 20 bp, Artificial Sequence
  Description of Artificial Sequence: Synthetic oligonucleotide
  Target: AGXT; (-) strand; PAM type: NRG; PAM sequence: GAG
accacccacccagcgtccat

SEQ ID NO: 9402 - DNA, 20 bp, Artificial Sequence
  Description of Artificial Sequence: Synthetic oligonucleotide
  Target: AGXT; (-) strand; PAM type: NRG; PAM sequence: CAG
ctgagtgaggaccacccacc

SEQ ID NO: 9403 - DNA, 20 bp, Artificial Sequence
  Description of Artificial Sequence: Synthetic oligonucleotide
  Target: AGXT; (-) strand; PAM type: NRG; PAM sequence: AGG
aggatgggctcacctgagtg

SEQ ID NO: 9404 - DNA, 20 bp, Artificial Sequence
  Description of Artificial Sequence: Synthetic oligonucleotide
  Target: AGXT; (-) strand; PAM type: NRG; PAM sequence: GAG
caggatgggctcacctgagt

SEQ ID NO: 9405 - DNA, 20 bp, Artificial Sequence
  Description of Artificial Sequence: Synthetic oligonucleotide
  Target: AGXT; (-) strand; PAM type: NRG; PAM sequence: GAG
gagccaggatgggctcacct

SEQ ID NO: 9406 - DNA, 20 bp, Artificial Sequence
  Description of Artificial Sequence: Synthetic oligonucleotide
  Target: AGXT; (-) strand; PAM type: NRG; PAM sequence: GGG
cagctggccagagccaggat

SEQ ID NO: 9407 - DNA, 20 bp, Artificial Sequence
  Description of Artificial Sequence: Synthetic oligonucleotide
  Target: AGXT; (-) strand; PAM type: NRG; PAM sequence: TGG
acagctggccagagccagga

SEQ ID NO: 9408 - DNA, 20 bp, Artificial Sequence
  Description of Artificial Sequence: Synthetic oligonucleotide
  Target: AGXT; (-) strand; PAM type: NRG; PAM sequence: AGG
accgacagctggccagagcc

SEQ ID NO: 9409 - DNA, 20 bp, Artificial Sequence
  Description of Artificial Sequence: Synthetic oligonucleotide
  Target: AGXT; (-) strand; PAM type: NRG; PAM sequence: CAG
gaccgacagctggccagagc

SEQ ID NO: 9410 - DNA, 20 bp, Artificial Sequence
  Description of Artificial Sequence: Synthetic oligonucleotide
  Target: AGXT; (-) strand; PAM type: NRG; PAM sequence: GAG
ccctgaccgacagctggcca

SEQ ID NO: 9411 - DNA, 20 bp, Artificial Sequence
  Description of Artificial Sequence: Synthetic oligonucleotide
  Target: AGXT; (-) strand; PAM type: NRG; PAM sequence: CAG
gaccctgaccgacagctggc

SEQ ID NO: 9412 - DNA, 20 bp, Artificial Sequence
  Description of Artificial Sequence: Synthetic oligonucleotide
  Target: AGXT; (-) strand; PAM type: NRG; PAM sequence: TGG
gcctgaccctgaccgacagc

SEQ ID NO: 9413 - DNA, 20 bp, Artificial Sequence
  Description of Artificial Sequence: Synthetic oligonucleotide
  Target: AGXT; (-) strand; PAM type: NRG; PAM sequence: CAG
acctgcctgaccctgaccga

SEQ ID NO: 9414 - DNA, 20 bp, Artificial Sequence
  Description of Artificial Sequence: Synthetic oligonucleotide
  Target: AGXT; (-) strand; PAM type: NRG; PAM sequence: GGG
ctgacgtcagcctcccgcct

SEQ ID NO: 9415 - DNA, 20 bp, Artificial Sequence
  Description of Artificial Sequence: Synthetic oligonucleotide
  Target: AGXT; (-) strand; PAM type: NRG; PAM sequence: TGG
gctgacgtcagcctcccgcc

SEQ ID NO: 9416 - DNA, 20 bp, Artificial Sequence
  Description of Artificial Sequence: Synthetic oligonucleotide
  Target: AGXT; (-) strand; PAM type: NRG; PAM sequence: CAG
ggcacagggcgggctgacgt

SEQ ID NO: 9417 - DNA, 20 bp, Artificial Sequence
  Description of Artificial Sequence: Synthetic oligonucleotide
  Target: AGXT; (-) strand; PAM type: NRG; PAM sequence: GGG
gcacctggggggcacagggc

SEQ ID NO: 9418 - DNA, 20 bp, Artificial Sequence
  Description of Artificial Sequence: Synthetic oligonucleotide
  Target: AGXT; (-) strand; PAM type: NRG; PAM sequence: CGG
agcacctggggggcacaggg

SEQ ID NO: 9419 - DNA, 20 bp, Artificial Sequence
  Description of Artificial Sequence: Synthetic oligonucleotide
  Target: AGXT; (-) strand; PAM type: NRG; PAM sequence: GGG
cgcagcacctggggggcaca

SEQ ID NO: 9420 - DNA, 20 bp, Artificial Sequence
  Description of Artificial Sequence: Synthetic oligonucleotide
  Target: AGXT; (-) strand; PAM type: NRG; PAM sequence: AGG
ccgcagcacctggggggcac

SEQ ID NO: 9421 - DNA, 20 bp, Artificial Sequence
  Description of Artificial Sequence: Synthetic oligonucleotide
  Target: AGXT; (-) strand; PAM type: NRG; PAM sequence: CAG
tccgcagcacctggggggca

SEQ ID NO: 9422 - DNA, 20 bp, Artificial Sequence
  Description of Artificial Sequence: Synthetic oligonucleotide
  Target: AGXT; (-) strand; PAM type: NRG; PAM sequence: GGG
gccgatccgcagcacctggg

SEQ ID NO: 9423 - DNA, 20 bp, Artificial Sequence
  Description of Artificial Sequence: Synthetic oligonucleotide
  Target: AGXT; (-) strand; PAM type: NRG; PAM sequence: GGG
ggccgatccgcagcacctgg

SEQ ID NO: 9424 - DNA, 20 bp, Artificial Sequence
  Description of Artificial Sequence: Synthetic oligonucleotide
  Target: AGXT; (-) strand; PAM type: NRG; PAM sequence: GGG
aggccgatccgcagcacctg

SEQ ID NO: 9425 - DNA, 20 bp, Artificial Sequence
  Description of Artificial Sequence: Synthetic oligonucleotide
  Target: AGXT; (-) strand; PAM type: NRG; PAM sequence: GGG
caggccgatccgcagcacct

SEQ ID NO: 9426 - DNA, 20 bp, Artificial Sequence
  Description of Artificial Sequence: Synthetic oligonucleotide
  Target: AGXT; (-) strand; PAM type: NRG; PAM sequence: TGG
gcaggccgatccgcagcacc

SEQ ID NO: 9427 - DNA, 20 bp, Artificial Sequence
  Description of Artificial Sequence: Synthetic oligonucleotide
  Target: AGXT; (-) strand; PAM type: NRG; PAM sequence: CAG
cagcccagcaggccgatccg

SEQ ID NO: 9428 - DNA, 20 bp, Artificial Sequence
  Description of Artificial Sequence: Synthetic oligonucleotide
  Target: AGXT; (-) strand; PAM type: NRG; PAM sequence: AGG
gggtggcattgcagcccagc

SEQ ID NO: 9429 - DNA, 20 bp, Artificial Sequence
  Description of Artificial Sequence: Synthetic oligonucleotide
  Target: AGXT; (-) strand; PAM type: NRG; PAM sequence: CAG
cgggtggcattgcagcccag

SEQ ID NO: 9430 - DNA, 20 bp, Artificial Sequence
  Description of Artificial Sequence: Synthetic oligonucleotide
  Target: AGXT; (-) strand; PAM type: NRG; PAM sequence: CAG
tcgcgggtggcattgcagcc

SEQ ID NO: 9431 - DNA, 20 bp, Artificial Sequence
  Description of Artificial Sequence: Synthetic oligonucleotide
  Target: AGXT; (-) strand; PAM type: NRG; PAM sequence: CAG
cattctcgcgggtggcattg

SEQ ID NO: 9432 - DNA, 20 bp, Artificial Sequence
  Description of Artificial Sequence: Synthetic oligonucleotide
  Target: AGXT; (-) strand; PAM type: NRG; PAM sequence: TGG
gcggtccacattctcgcggg

SEQ ID NO: 9433 - DNA, 20 bp, Artificial Sequence
  Description of Artificial Sequence: Synthetic oligonucleotide
  Target: AGXT; (-) strand; PAM type: NRG; PAM sequence: GGG
cacgcggtccacattctcgc

SEQ ID NO: 9434 - DNA, 20 bp, Artificial Sequence
  Description of Artificial Sequence: Synthetic oligonucleotide
  Target: AGXT; (-) strand; PAM type: NRG; PAM sequence: CGG
tcacgcggtccacattctcg

SEQ ID NO: 9435 - DNA, 20 bp, Artificial Sequence
  Description of Artificial Sequence: Synthetic oligonucleotide
  Target: AGXT; (-) strand; PAM type: NRG; PAM sequence: CGG
ccctcagggcctccgtcacg

SEQ ID NO: 9436 - DNA, 20 bp, Artificial Sequence
  Description of Artificial Sequence: Synthetic oligonucleotide
  Target: AGXT; (-) strand; PAM type: NRG; PAM sequence: GGG
gtgctgcagggccgccctca

SEQ ID NO: 9437 - DNA, 20 bp, Artificial Sequence
  Description of Artificial Sequence: Synthetic oligonucleotide
  Target: AGXT; (-) strand; PAM type: NRG; PAM sequence: AGG
agtgctgcagggccgccctc

SEQ ID NO: 9438 - DNA, 20 bp, Artificial Sequence
  Description of Artificial Sequence: Synthetic oligonucleotide
  Target: AGXT; (-) strand; PAM type: NRG; PAM sequence: CAG
cagtgctgcagggccgccct

SEQ ID NO: 9439 - DNA, 20 bp, Artificial Sequence
  Description of Artificial Sequence: Synthetic oligonucleotide
  Target: AGXT; (-) strand; PAM type: NRG; PAM sequence: GGG
cttcttggggcagtgctgca

SEQ ID NO: 9440 - DNA, 20 bp, Artificial Sequence
  Description of Artificial Sequence: Synthetic oligonucleotide
  Target: AGXT; (-) strand; PAM type: NRG; PAM sequence: AGG
tcttcttggggcagtgctgc

SEQ ID NO: 9441 - DNA, 20 bp, Artificial Sequence
  Description of Artificial Sequence: Synthetic oligonucleotide
  Target: AGXT; (-) strand; PAM type: NRG; PAM sequence: CAG
ttcttcttggggcagtgctg

SEQ ID NO: 9442 - DNA, 20 bp, Artificial Sequence
  Description of Artificial Sequence: Synthetic oligonucleotide
  Target: AGXT; (-) strand; PAM type: NRG; PAM sequence: CAG
gtcacagcttcttcttgggg

SEQ ID NO: 9443 - DNA, 20 bp, Artificial Sequence
  Description of Artificial Sequence: Synthetic oligonucleotide
  Target: AGXT; (-) strand; PAM type: NRG; PAM sequence: GGG
caggtcacagcttcttcttg

SEQ ID NO: 9444 - DNA, 20 bp, Artificial Sequence
  Description of Artificial Sequence: Synthetic oligonucleotide
  Target: AGXT; (-) strand; PAM type: NRG; PAM sequence: GGG
gcaggtcacagcttcttctt

SEQ ID NO: 9445 - DNA, 20 bp, Artificial Sequence
  Description of Artificial Sequence: Synthetic oligonucleotide
  Target: AGXT; (-) strand; PAM type: NRG; PAM sequence: TGG
ggcaggtcacagcttcttct

SEQ ID NO: 9446 - DNA, 20 bp, Artificial Sequence
  Description of Artificial Sequence: Synthetic oligonucleotide
  Target: AGXT; (-) strand; PAM type: NRG; PAM sequence: CAG
gtgtgccagtgggcaggtca

SEQ ID NO: 9447 - DNA, 20 bp, Artificial Sequence
  Description of Artificial Sequence: Synthetic oligonucleotide
  Target: AGXT; (-) strand; PAM type: NRG; PAM sequence: AGG
ccagctgtgtgccagtgggc

SEQ ID NO: 9448 - DNA, 20 bp, Artificial Sequence
  Description of Artificial Sequence: Synthetic oligonucleotide
  Target: AGXT; (-) strand; PAM type: NRG; PAM sequence: CAG
gccagctgtgtgccagtggg

SEQ ID NO: 9449 - DNA, 20 bp, Artificial Sequence
  Description of Artificial Sequence: Synthetic oligonucleotide
  Target: AGXT; (-) strand; PAM type: NRG; PAM sequence: GGG
agtgccagctgtgtgccagt

SEQ ID NO: 9450 - DNA, 20 bp, Artificial Sequence
  Description of Artificial Sequence: Synthetic oligonucleotide
  Target: AGXT; (-) strand; PAM type: NRG; PAM sequence: TGG
cagtgccagctgtgtgccag

SEQ ID NO: 9451 - DNA, 20 bp, Artificial Sequence
  Description of Artificial Sequence: Synthetic oligonucleotide
  Target: AGXT; (-) strand; PAM type: NRG; PAM sequence: CAG
tgccagtgccagctgtgtgc

SEQ ID NO: 9452 - DNA, 20 bp, Artificial Sequence
  Description of Artificial Sequence: Synthetic oligonucleotide
  Target: AGXT; (-) strand; PAM type: NRG; PAM sequence: CAG
ggacaggtgtgtgccagtgc

SEQ ID NO: 9453 - DNA, 20 bp, Artificial Sequence
  Description of Artificial Sequence: Synthetic oligonucleotide
  Target: AGXT; (-) strand; PAM type: NRG; PAM sequence: CAG
ggcatgggacaggtgtgtgc

SEQ ID NO: 9454 - DNA, 20 bp, Artificial Sequence
  Description of Artificial Sequence: Synthetic oligonucleotide
  Target: AGXT; (-) strand; PAM type: NRG; PAM sequence: AGG
cctcagggtgggcatgggac

SEQ ID NO: 9455 - DNA, 20 bp, Artificial Sequence
  Description of Artificial Sequence: Synthetic oligonucleotide
  Target: AGXT; (-) strand; PAM type: NRG; PAM sequence: CAG
ccctcagggtgggcatggga

SEQ ID NO: 9456 - DNA, 20 bp, Artificial Sequence
  Description of Artificial Sequence: Synthetic oligonucleotide
  Target: AGXT; (-) strand; PAM type: NRG; PAM sequence: GGG
tgatccctcagggtgggcat

SEQ ID NO: 9457 - DNA, 20 bp, Artificial Sequence
  Description of Artificial Sequence: Synthetic oligonucleotide
  Target: AGXT; (-) strand; PAM type: NRG; PAM sequence: TGG
ctgatccctcagggtgggca

SEQ ID NO: 9458 - DNA, 20 bp, Artificial Sequence
  Description of Artificial Sequence: Synthetic oligonucleotide
  Target: AGXT; (-) strand; PAM type: NRG; PAM sequence: GGG
tgctcctgatccctcagggt

SEQ ID NO: 9459 - DNA, 20 bp, Artificial Sequence
  Description of Artificial Sequence: Synthetic oligonucleotide
  Target: AGXT; (-) strand; PAM type: NRG; PAM sequence: TGG
ttgctcctgatccctcaggg

SEQ ID NO: 9460 - DNA, 20 bp, Artificial Sequence
  Description of Artificial Sequence: Synthetic oligonucleotide
  Target: AGXT; (-) strand; PAM type: NRG; PAM sequence: GGG
tgtttgctcctgatccctca

SEQ ID NO: 9461 - DNA, 20 bp, Artificial Sequence
  Description of Artificial Sequence: Synthetic oligonucleotide
  Target: AGXT; (-) strand; PAM type: NRG; PAM sequence: AGG
ctgtttgctcctgatccctc

SEQ ID NO: 9462 - DNA, 20 bp, Artificial Sequence
  Description of Artificial Sequence: Synthetic oligonucleotide
  Target: AGXT; (-) strand; PAM type: NRG; PAM sequence: CAG
tctgtttgctcctgatccct

SEQ ID NO: 9463 - DNA, 20 bp, Artificial Sequence
  Description of Artificial Sequence: Synthetic oligonucleotide
  Target: AGXT; (-) strand; PAM type: NRG; PAM sequence: GGG
caggcctggaggaccttgca

SEQ ID NO: 9464 - DNA, 20 bp, Artificial Sequence
  Description of Artificial Sequence: Synthetic oligonucleotide
  Target: AGXT; (-) strand; PAM type: NRG; PAM sequence: AGG
ccaggcctggaggaccttgc

SEQ ID NO: 9465 - DNA, 20 bp, Artificial Sequence
  Description of Artificial Sequence: Synthetic oligonucleotide
  Target: AGXT; (-) strand; PAM type: NRG; PAM sequence: CAG
cccaggcctggaggaccttg

SEQ ID NO: 9466 - DNA, 20 bp, Artificial Sequence
  Description of Artificial Sequence: Synthetic oligonucleotide
  Target: AGXT; (-) strand; PAM type: NRG; PAM sequence: AGG
tttcctgtccccaggcctgg

SEQ ID NO: 9467 - DNA, 20 bp, Artificial Sequence
  Description of Artificial Sequence: Synthetic oligonucleotide
  Target: AGXT; (-) strand; PAM type: NRG; PAM sequence: GAG
ctttcctgtccccaggcctg

SEQ ID NO: 9468 - DNA, 20 bp, Artificial Sequence
  Description of Artificial Sequence: Synthetic oligonucleotide
  Target: AGXT; (-) strand; PAM type: NRG; PAM sequence: TGG
ggctttcctgtccccaggcc

SEQ ID NO: 9469 - DNA, 20 bp, Artificial Sequence
  Description of Artificial Sequence: Synthetic oligonucleotide
  Target: AGXT; (-) strand; PAM type: NRG; PAM sequence: AGG
tcagtggctttcctgtcccc

SEQ ID NO: 9470 - DNA, 20 bp, Artificial Sequence
  Description of Artificial Sequence: Synthetic oligonucleotide
  Target: AGXT; (-) strand; PAM type: NRG; PAM sequence: CAG
gtcagtggctttcctgtccc

SEQ ID NO: 9471 - DNA, 20 bp, Artificial Sequence
  Description of Artificial Sequence: Synthetic oligonucleotide
  Target: AGXT; (-) strand; PAM type: NRG; PAM sequence: TGG
tgcctcccgggctgggtcag

SEQ ID NO: 9472 - DNA, 20 bp, Artificial Sequence
  Description of Artificial Sequence: Synthetic oligonucleotide
  Target: AGXT; (-) strand; PAM type: NRG; PAM sequence: CAG
ttctgcctcccgggctgggt

SEQ ID NO: 9473 - DNA, 20 bp, Artificial Sequence
  Description of Artificial Sequence: Synthetic oligonucleotide
  Target: AGXT; (-) strand; PAM type: NRG; PAM sequence: GGG
ctggttctgcctcccgggct

SEQ ID NO: 9474 - DNA, 20 bp, Artificial Sequence
  Description of Artificial Sequence: Synthetic oligonucleotide
  Target: AGXT; (-) strand; PAM type: NRG; PAM sequence: TGG
cctggttctgcctcccgggc

SEQ ID NO: 9475 - DNA, 20 bp, Artificial Sequence
  Description of Artificial Sequence: Synthetic oligonucleotide
  Target: AGXT; (-) strand; PAM type: NRG; PAM sequence: GGG
gctgcctggttctgcctccc

SEQ ID NO: 9476 - DNA, 20 bp, Artificial Sequence
  Description of Artificial Sequence: Synthetic oligonucleotide
  Target: AGXT; (-) strand; PAM type: NRG; PAM sequence: CGG
ggctgcctggttctgcctcc

SEQ ID NO: 9477 - DNA, 20 bp, Artificial Sequence
  Description of Artificial Sequence: Synthetic oligonucleotide
  Target: AGXT; (-) strand; PAM type: NRG; PAM sequence: TGG
ctggggccagggaggctgcc

SEQ ID NO: 9478 - DNA, 20 bp, Artificial Sequence
  Description of Artificial Sequence: Synthetic oligonucleotide
  Target: AGXT; (-) strand; PAM type: NRG; PAM sequence: AGG
agggctgcctggggccaggg

SEQ ID NO: 9479 - DNA, 20 bp, Artificial Sequence
  Description of Artificial Sequence: Synthetic oligonucleotide
  Target: AGXT; (-) strand; PAM type: NRG; PAM sequence: GAG
aagggctgcctggggccagg

SEQ ID NO: 9480 - DNA, 20 bp, Artificial Sequence
  Description of Artificial Sequence: Synthetic oligonucleotide
  Target: AGXT; (-) strand; PAM type: NRG; PAM sequence: GGG
aaaagggctgcctggggcca

SEQ ID NO: 9481 - DNA, 20 bp, Artificial Sequence
  Description of Artificial Sequence: Synthetic oligonucleotide
  Target: AGXT; (-) strand; PAM type: NRG; PAM sequence: AGG
gaaaagggctgcctggggcc

SEQ ID NO: 9482 - DNA, 20 bp, Artificial Sequence
  Description of Artificial Sequence: Synthetic oligonucleotide
  Target: AGXT; (-) strand; PAM type: NRG; PAM sequence: CAG
ggaaaagggctgcctggggc

SEQ ID NO: 9483 - DNA, 20 bp, Artificial Sequence
  Description of Artificial Sequence: Synthetic oligonucleotide
  Target: AGXT; (-) strand; PAM type: NRG; PAM sequence: GGG
ggagggaaaagggctgcctg

SEQ ID NO: 9484 - DNA, 20 bp, Artificial Sequence
  Description of Artificial Sequence: Synthetic oligonucleotide
  Target: AGXT; (-) strand; PAM type: NRG; PAM sequence: GGG
tggagggaaaagggctgcct

SEQ ID NO: 9485 - DNA, 20 bp, Artificial Sequence
  Description of Artificial Sequence: Synthetic oligonucleotide
  Target: AGXT; (-) strand; PAM type: NRG; PAM sequence: TGG
ctggagggaaaagggctgcc

SEQ ID NO: 9486 - DNA, 20 bp, Artificial Sequence
  Description of Artificial Sequence: Synthetic oligonucleotide
  Target: AGXT; (-) strand; PAM type: NRG; PAM sequence: GGG
aggtgccactggagggaaaa

SEQ ID NO: 9487 - DNA, 20 bp, Artificial Sequence
  Description of Artificial Sequence: Synthetic oligonucleotide
  Target: AGXT; (-) strand; PAM type: NRG; PAM sequence: AGG
gaggtgccactggagggaaa

SEQ ID NO: 9488 - DNA, 20 bp, Artificial Sequence
  Description of Artificial Sequence: Synthetic oligonucleotide
  Target: AGXT; (-) strand; PAM type: NRG; PAM sequence: AAG
ggaggtgccactggagggaa

SEQ ID NO: 9489 - DNA, 20 bp, Artificial Sequence
  Description of Artificial Sequence: Synthetic oligonucleotide
  Target: AGXT; (-) strand; PAM type: NRG; PAM sequence: GGG
ttccaggaggtgccactgga

SEQ ID NO: 9490 - DNA, 20 bp, Artificial Sequence
  Description of Artificial Sequence: Synthetic oligonucleotide
  Target: AGXT; (-) strand; PAM type: NRG; PAM sequence: AGG
tttccaggaggtgccactgg

SEQ ID NO: 9491 - DNA, 20 bp, Artificial Sequence
  Description of Artificial Sequence: Synthetic oligonucleotide
  Target: AGXT; (-) strand; PAM type: NRG; PAM sequence: GAG
gtttccaggaggtgccactg

SEQ ID NO: 9492 - DNA, 20 bp, Artificial Sequence
  Description of Artificial Sequence: Synthetic oligonucleotide
  Target: AGXT; (-) strand; PAM type: NRG; PAM sequence: TGG
ctgtttccaggaggtgccac

SEQ ID NO: 9493 - DNA, 20 bp, Artificial Sequence
  Description of Artificial Sequence: Synthetic oligonucleotide
  Target: AGXT; (-) strand; PAM type: NRG; PAM sequence: AGG
ccaagtggactgtttccagg

SEQ ID NO: 9494 - DNA, 20 bp, Artificial Sequence
  Description of Artificial Sequence: Synthetic oligonucleotide
  Target: AGXT; (-) strand; PAM type: NRG; PAM sequence: GAG
cccaagtggactgtttccag

SEQ ID NO: 9495 - DNA, 20 bp, Artificial Sequence
  Description of Artificial Sequence: Synthetic oligonucleotide
  Target: AGXT; (-) strand; PAM type: NRG; PAM sequence: AGG
cgcccaagtggactgtttcc

SEQ ID NO: 9496 - DNA, 20 bp, Artificial Sequence
  Description of Artificial Sequence: Synthetic oligonucleotide
  Target: AGXT; (-) strand; PAM type: NRG; PAM sequence: CAG
gcgcccaagtggactgtttc

SEQ ID NO: 9497 - DNA, 20 bp, Artificial Sequence
  Description of Artificial Sequence: Synthetic oligonucleotide
  Target: AGXT; (-) strand; PAM type: NRG; PAM sequence: TGG
cactgggttttgcgcccaag

SEQ ID NO: 9498 - DNA, 20 bp, Artificial Sequence
  Description of Artificial Sequence: Synthetic oligonucleotide
  Target: AGXT; (-) strand; PAM type: NRG; PAM sequence: AAG
aggcactgggttttgcgccc

SEQ ID NO: 9499 - DNA, 20 bp, Artificial Sequence
  Description of Artificial Sequence: Synthetic oligonucleotide
  Target: AGXT; (-) strand; PAM type: NRG; PAM sequence: GGG
cagctcatttggaaggcact

SEQ ID NO: 9500 - DNA, 20 bp, Artificial Sequence
  Description of Artificial Sequence: Synthetic oligonucleotide
  Target: AGXT; (-) strand; PAM type: NRG; PAM sequence: TGG
gcagctcatttggaaggcac

SEQ ID NO: 9501 - DNA, 20 bp, Artificial Sequence
  Description of Artificial Sequence: Synthetic oligonucleotide
  Target: AGXT; (-) strand; PAM type: NRG; PAM sequence: AGG
gggactgcagctcatttgga

SEQ ID NO: 9502 - DNA, 20 bp, Artificial Sequence
  Description of Artificial Sequence: Synthetic oligonucleotide
  Target: AGXT; (-) strand; PAM type: NRG; PAM sequence: AAG
ggggactgcagctcatttgg

SEQ ID NO: 9503 - DNA, 20 bp, Artificial Sequence
  Description of Artificial Sequence: Synthetic oligonucleotide
  Target: AGXT; (-) strand; PAM type: NRG; PAM sequence: TGG
cctggggactgcagctcatt

SEQ ID NO: 9504 - DNA, 20 bp, Artificial Sequence
  Description of Artificial Sequence: Synthetic oligonucleotide
  Target: AGXT; (-) strand; PAM type: NRG; PAM sequence: CAG
ggctcatggcctggggactg

SEQ ID NO: 9505 - DNA, 20 bp, Artificial Sequence
  Description of Artificial Sequence: Synthetic oligonucleotide
  Target: AGXT; (-) strand; PAM type: NRG; PAM sequence: GGG
cccgggaggctcatggcctg

SEQ ID NO: 9506 - DNA, 20 bp, Artificial Sequence
  Description of Artificial Sequence: Synthetic oligonucleotide
  Target: AGXT; (-) strand; PAM type: NRG; PAM sequence: GGG
tcccgggaggctcatggcct

SEQ ID NO: 9507 - DNA, 20 bp, Artificial Sequence
  Description of Artificial Sequence: Synthetic oligonucleotide
  Target: AGXT; (-) strand; PAM type: NRG; PAM sequence: TGG
ttcccgggaggctcatggcc

SEQ ID NO: 9508 - DNA, 20 bp, Artificial Sequence
  Description of Artificial Sequence: Synthetic oligonucleotide
  Target: AGXT; (-) strand; PAM type: NRG; PAM sequence: TGG
aaacattcccgggaggctca

SEQ ID NO: 9509 - DNA, 20 bp, Artificial Sequence
  Description of Artificial Sequence: Synthetic oligonucleotide
  Target: AGXT; (-) strand; PAM type: NRG; PAM sequence: AGG
ctttattaaacattcccggg

SEQ ID NO: 9510 - DNA, 20 bp, Artificial Sequence
  Description of Artificial Sequence: Synthetic oligonucleotide
  Target: AGXT; (-) strand; PAM type: NRG; PAM sequence: GAG
cctttattaaacattcccgg

SEQ ID NO: 9511 - DNA, 20 bp, Artificial Sequence
  Description of Artificial Sequence: Synthetic oligonucleotide
  Target: AGXT; (-) strand; PAM type: NRG; PAM sequence: GGG
gccctttattaaacattccc

SEQ ID NO: 9512 - DNA, 20 bp, Artificial Sequence
  Description of Artificial Sequence: Synthetic oligonucleotide
  Target: AGXT; (-) strand; PAM type: NRG; PAM sequence: CGG
ggccctttattaaacattcc

SEQ ID NO: 9513 - DNA, 20 bp, Artificial Sequence
  Description of Artificial Sequence: Synthetic oligonucleotide
  Target: AGXT; (-) strand; PAM type: NRG; PAM sequence: AGG
cacagtgaggagagttggcc

SEQ ID NO: 9514 - DNA, 20 bp, Artificial Sequence
  Description of Artificial Sequence: Synthetic oligonucleotide
  Target: AGXT; (-) strand; PAM type: NRG; PAM sequence: CAG
acacagtgaggagagttggc

SEQ ID NO: 9515 - DNA, 20 bp, Artificial Sequence
  Description of Artificial Sequence: Synthetic oligonucleotide
  Target: AGXT; (-) strand; PAM type: NRG; PAM sequence: TGG
ccccacacagtgaggagagt

SEQ ID NO: 9516 - DNA, 20 bp, Artificial Sequence
  Description of Artificial Sequence: Synthetic oligonucleotide
  Target: AGXT; (-) strand; PAM type: NRG; PAM sequence: GAG
accaccccacacagtgagga

SEQ ID NO: 9517 - DNA, 20 bp, Artificial Sequence
  Description of Artificial Sequence: Synthetic oligonucleotide
  Target: AGXT; (-) strand; PAM type: NRG; PAM sequence: GAG
agaccaccccacacagtgag

SEQ ID NO: 9518 - DNA, 20 bp, Artificial Sequence
  Description of Artificial Sequence: Synthetic oligonucleotide
  Target: AGXT; (-) strand; PAM type: NRG; PAM sequence: AGG
acagaccaccccacacagtg

SEQ ID NO: 9519 - DNA, 20 bp, Artificial Sequence
  Description of Artificial Sequence: Synthetic oligonucleotide
  Target: AGXT; (-) strand; PAM type: NRG; PAM sequence: GAG
cacagaccaccccacacagt

SEQ ID NO: 9520 - DNA, 20 bp, Artificial Sequence
  Description of Artificial Sequence: Synthetic oligonucleotide
  Target: AGXT; (-) strand; PAM type: NRG; PAM sequence: CAG
ctttcacagaccaccccaca

SEQ ID NO: 9521 - DNA, 20 bp, Artificial Sequence
  Description of Artificial Sequence: Synthetic oligonucleotide
  Target: AGXT; (-) strand; PAM type: NRG; PAM sequence: CAG
gctctcctctcactctttca

SEQ ID NO: 9522 - DNA, 20 bp, Artificial Sequence
  Description of Artificial Sequence: Synthetic oligonucleotide
  Target: AGXT; (-) strand; PAM type: NRG; PAM sequence: GAG
atcaggcagctcagggagca

SEQ ID NO: 9523 - DNA, 20 bp, Artificial Sequence
  Description of Artificial Sequence: Synthetic oligonucleotide
  Target: AGXT; (-) strand; PAM type: NRG; PAM sequence: CAG
caatcaggcagctcagggag

SEQ ID NO: 9524 - DNA, 20 bp, Artificial Sequence
  Description of Artificial Sequence: Synthetic oligonucleotide
  Target: AGXT; (-) strand; PAM type: NRG; PAM sequence: GAG
ccacaatcaggcagctcagg

SEQ ID NO: 9525 - DNA, 20 bp, Artificial Sequence
  Description of Artificial Sequence: Synthetic oligonucleotide
  Target: AGXT; (-) strand; PAM type: NRG; PAM sequence: GGG
gtccacaatcaggcagctca

SEQ ID NO: 9526 - DNA, 20 bp, Artificial Sequence
  Description of Artificial Sequence: Synthetic oligonucleotide
  Target: AGXT; (-) strand; PAM type: NRG; PAM sequence: AGG
agtccacaatcaggcagctc

SEQ ID NO: 9527 - DNA, 20 bp, Artificial Sequence
  Description of Artificial Sequence: Synthetic oligonucleotide
  Target: AGXT; (-) strand; PAM type: NRG; PAM sequence: CAG
aagtccacaatcaggcagct

SEQ ID NO: 9528 - DNA, 20 bp, Artificial Sequence
  Description of Artificial Sequence: Synthetic oligonucleotide
  Target: AGXT; (-) strand; PAM type: NRG; PAM sequence: CAG
ccctaaagtccacaatcagg

SEQ ID NO: 9529 - DNA, 20 bp, Artificial Sequence
  Description of Artificial Sequence: Synthetic oligonucleotide
  Target: AGXT; (-) strand; PAM type: NRG; PAM sequence: AGG
tccccctaaagtccacaatc

SEQ ID NO: 9530 - DNA, 20 bp, Artificial Sequence
  Description of Artificial Sequence: Synthetic oligonucleotide
  Target: AGXT; (-) strand; PAM type: NRG; PAM sequence: CAG
gtccccctaaagtccacaat

SEQ ID NO: 9531 - DNA, 20 bp, Artificial Sequence
  Description of Artificial Sequence: Synthetic oligonucleotide
  Target: AGXT; (-) strand; PAM type: NRG; PAM sequence: AAG
ggatgaggagtgtcccccta

SEQ ID NO: 9532 - DNA, 20 bp, Artificial Sequence
  Description of Artificial Sequence: Synthetic oligonucleotide
  Target: AGXT; (-) strand; PAM type: NRG; PAM sequence: GAG
cctgtgggctccaggatgag

SEQ ID NO: 9533 - DNA, 20 bp, Artificial Sequence
  Description of Artificial Sequence: Synthetic oligonucleotide
  Target: AGXT; (-) strand; PAM type: NRG; PAM sequence: AGG
accctgtgggctccaggatg

SEQ ID NO: 9534 - DNA, 20 bp, Artificial Sequence
  Description of Artificial Sequence: Synthetic oligonucleotide
  Target: AGXT; (-) strand; PAM type: NRG; PAM sequence: GAG
taccctgtgggctccaggat

SEQ ID NO: 9535 - DNA, 20 bp, Artificial Sequence
  Description of Artificial Sequence: Synthetic oligonucleotide
  Target: AGXT; (-) strand; PAM type: NRG; PAM sequence: AGG
ggatctaccctgtgggctcc

SEQ ID NO: 9536 - DNA, 20 bp, Artificial Sequence
  Description of Artificial Sequence: Synthetic oligonucleotide
  Target: AGXT; (-) strand; PAM type: NRG; PAM sequence: CAG
aggatctaccctgtgggctc

SEQ ID NO: 9537 - DNA, 20 bp, Artificial Sequence
  Description of Artificial Sequence: Synthetic oligonucleotide
  Target: AGXT; (-) strand; PAM type: NRG; PAM sequence: GGG
caggggaggatctaccctgt

SEQ ID NO: 9538 - DNA, 20 bp, Artificial Sequence
  Description of Artificial Sequence: Synthetic oligonucleotide
  Target: AGXT; (-) strand; PAM type: NRG; PAM sequence: TGG
ccaggggaggatctaccctg

SEQ ID NO: 9539 - DNA, 20 bp, Artificial Sequence
  Description of Artificial Sequence: Synthetic oligonucleotide
  Target: AGXT; (-) strand; PAM type: NRG; PAM sequence: AGG
gacagcacctcctccagggg

SEQ ID NO: 9540 - DNA, 20 bp, Artificial Sequence
  Description of Artificial Sequence: Synthetic oligonucleotide
  Target: AGXT; (-) strand; PAM type: NRG; PAM sequence: GAG
tgacagcacctcctccaggg

SEQ ID NO: 9541 - DNA, 20 bp, Artificial Sequence
  Description of Artificial Sequence: Synthetic oligonucleotide
  Target: AGXT; (-) strand; PAM type: NRG; PAM sequence: GGG
ggtgacagcacctcctccag

SEQ ID NO: 9542 - DNA, 20 bp, Artificial Sequence
  Description of Artificial Sequence: Synthetic oligonucleotide
  Target: AGXT; (-) strand; PAM type: NRG; PAM sequence: GGG
tggtgacagcacctcctcca

SEQ ID NO: 9543 - DNA, 20 bp, Artificial Sequence
  Description of Artificial Sequence: Synthetic oligonucleotide
  Target: AGXT; (-) strand; PAM type: NRG; PAM sequence: AGG
gtggtgacagcacctcctcc

SEQ ID NO: 9544 - DNA, 20 bp, Artificial Sequence
  Description of Artificial Sequence: Synthetic oligonucleotide
  Target: AGXT; (-) strand; PAM type: NRG; PAM sequence: CAG
tgtggtgacagcacctcctc

SEQ ID NO: 9545 - DNA, 20 bp, Artificial Sequence
  Description of Artificial Sequence: Synthetic oligonucleotide
  Target: AGXT; (-) strand; PAM type: NRG; PAM sequence: CAG
ctggggctagagtgtggtga

SEQ ID NO: 9546 - DNA, 20 bp, Artificial Sequence
  Description of Artificial Sequence: Synthetic oligonucleotide
  Target: AGXT; (-) strand; PAM type: NRG; PAM sequence: TGG
tgacatctggggctagagtg

SEQ ID NO: 9547 - DNA, 20 bp, Artificial Sequence
  Description of Artificial Sequence: Synthetic oligonucleotide
  Target: AGXT; (-) strand; PAM type: NRG; PAM sequence: GAG
gggtgtgacatctggggcta

SEQ ID NO: 9548 - DNA, 20 bp, Artificial Sequence
  Description of Artificial Sequence: Synthetic oligonucleotide
  Target: AGXT; (-) strand; PAM type: NRG; PAM sequence: TAG
gggggtgtgacatctggggc

SEQ ID NO: 9549 - DNA, 20 bp, Artificial Sequence
  Description of Artificial Sequence: Synthetic oligonucleotide
  Target: AGXT; (-) strand; PAM type: NRG; PAM sequence: GGG
gtttgggggtgtgacatctg

SEQ ID NO: 9550 - DNA, 20 bp, Artificial Sequence
  Description of Artificial Sequence: Synthetic oligonucleotide
  Target: AGXT; (-) strand; PAM type: NRG; PAM sequence: GGG
cgtttgggggtgtgacatct

SEQ ID NO: 9551 - DNA, 20 bp, Artificial Sequence
  Description of Artificial Sequence: Synthetic oligonucleotide
  Target: AGXT; (-) strand; PAM type: NRG; PAM sequence: TGG
acgtttgggggtgtgacatc

SEQ ID NO: 9552 - DNA, 20 bp, Artificial Sequence
  Description of Artificial Sequence: Synthetic oligonucleotide
  Target: AGXT; (-) strand; PAM type: NRG; PAM sequence: GGG
tggtgcgtgaggacgtttgg

SEQ ID NO: 9553 - DNA, 20 bp, Artificial Sequence
  Description of Artificial Sequence: Synthetic oligonucleotide
  Target: AGXT; (-) strand; PAM type: NRG; PAM sequence: GGG
gtggtgcgtgaggacgtttg

SEQ ID NO: 9554 - DNA, 20 bp, Artificial Sequence
  Description of Artificial Sequence: Synthetic oligonucleotide
  Target: AGXT; (-) strand; PAM type: NRG; PAM sequence: GGG
tgtggtgcgtgaggacgttt

SEQ ID NO: 9555 - DNA, 20 bp, Artificial Sequence
  Description of Artificial Sequence: Synthetic oligonucleotide
  Target: AGXT; (-) strand; PAM type: NRG; PAM sequence: TGG
atgtggtgcgtgaggacgtt

SEQ ID NO: 9556 - DNA, 20 bp, Artificial Sequence
  Description of Artificial Sequence: Synthetic oligonucleotide
  Target: AGXT; (-) strand; PAM type: NRG; PAM sequence: AGG
tcacctggatgtggtgcgtg

SEQ ID NO: 9557 - DNA, 20 bp, Artificial Sequence
  Description of Artificial Sequence: Synthetic oligonucleotide
  Target: AGXT; (-) strand; PAM type: NRG; PAM sequence: GAG
ttcacctggatgtggtgcgt

SEQ ID NO: 9558 - DNA, 20 bp, Artificial Sequence
  Description of Artificial Sequence: Synthetic oligonucleotide
  Target: AGXT; (-) strand; PAM type: NRG; PAM sequence: TGG
cgtgtgggttcacctggatg

SEQ ID NO: 9559 - DNA, 20 bp, Artificial Sequence
  Description of Artificial Sequence: Synthetic oligonucleotide
  Target: AGXT; (-) strand; PAM type: NRG; PAM sequence: TGG
gtgcgccgtgtgggttcacc

SEQ ID NO: 9560 - DNA, 20 bp, Artificial Sequence
  Description of Artificial Sequence: Synthetic oligonucleotide
  Target: AGXT; (-) strand; PAM type: NRG; PAM sequence: GGG
accagccctgtgcgccgtgt

SEQ ID NO: 9561 - DNA, 20 bp, Artificial Sequence
  Description of Artificial Sequence: Synthetic oligonucleotide
  Target: AGXT; (-) strand; PAM type: NRG; PAM sequence: TGG
aaccagccctgtgcgccgtg

SEQ ID NO: 9562 - DNA, 20 bp, Artificial Sequence
  Description of Artificial Sequence: Synthetic oligonucleotide
  Target: AGXT; (-) strand; PAM type: NRG; PAM sequence: CAG
ccatgacaggggtctccaac

SEQ ID NO: 9563 - DNA, 20 bp, Artificial Sequence
  Description of Artificial Sequence: Synthetic oligonucleotide
  Target: AGXT; (-) strand; PAM type: NRG; PAM sequence: GGG
ggtacccttgtccatgacag

SEQ ID NO: 9564 - DNA, 20 bp, Artificial Sequence
  Description of Artificial Sequence: Synthetic oligonucleotide
  Target: AGXT; (-) strand; PAM type: NRG; PAM sequence: GGG
aggtacccttgtccatgaca

SEQ ID NO: 9565 - DNA, 20 bp, Artificial Sequence
  Description of Artificial Sequence: Synthetic oligonucleotide
  Target: AGXT; (-) strand; PAM type: NRG; PAM sequence: AGG
caggtacccttgtccatgac

SEQ ID NO: 9566 - DNA, 20 bp, Artificial Sequence
  Description of Artificial Sequence: Synthetic oligonucleotide
  Target: AGXT; (-) strand; PAM type: NRG; PAM sequence: CAG
gcaggtacccttgtccatga

SEQ ID NO: 9567 - DNA, 20 bp, Artificial Sequence
  Description of Artificial Sequence: Synthetic oligonucleotide
  Target: AGXT; (-) strand; PAM type: NRG; PAM sequence: AGG
ctgtgcgctctccagcacgc

SEQ ID NO: 9568 - DNA, 20 bp, Artificial Sequence
  Description of Artificial Sequence: Synthetic oligonucleotide
  Target: AGXT; (-) strand; PAM type: NRG; PAM sequence: CAG
gctgtgcgctctccagcacg

SEQ ID NO: 9569 - DNA, 20 bp, Artificial Sequence
  Description of Artificial Sequence: Synthetic oligonucleotide
  Target: AGXT; (-) strand; PAM type: NRG; PAM sequence: CAG
ggtcctggctgtgcgctctc

SEQ ID NO: 9570 - DNA, 20 bp, Artificial Sequence
  Description of Artificial Sequence: Synthetic oligonucleotide
  Target: AGXT; (-) strand; PAM type: NRG; PAM sequence: TGG
cgtgtcatgggctcaggtcc

SEQ ID NO: 9571 - DNA, 20 bp, Artificial Sequence
  Description of Artificial Sequence: Synthetic oligonucleotide
  Target: AGXT; (-) strand; PAM type: NRG; PAM sequence: AGG
cttccacgtgtcatgggctc

SEQ ID NO: 9572 - DNA, 20 bp, Artificial Sequence
  Description of Artificial Sequence: Synthetic oligonucleotide
  Target: AGXT; (-) strand; PAM type: NRG; PAM sequence: CAG
gcttccacgtgtcatgggct

SEQ ID NO: 9573 - DNA, 20 bp, Artificial Sequence
  Description of Artificial Sequence: Synthetic oligonucleotide
  Target: AGXT; (-) strand; PAM type: NRG; PAM sequence: GGG
tggaggcttccacgtgtcat

SEQ ID NO: 9574 - DNA, 20 bp, Artificial Sequence
  Description of Artificial Sequence: Synthetic oligonucleotide
  Target: AGXT; (-) strand; PAM type: NRG; PAM sequence: TGG
ttggaggcttccacgtgtca

SEQ ID NO: 9575 - DNA, 20 bp, Artificial Sequence
  Description of Artificial Sequence: Synthetic oligonucleotide
  Target: AGXT; (-) strand; PAM type: NRG; PAM sequence: AGG
cataggggaccttccattgg

SEQ ID NO: 9576 - DNA, 20 bp, Artificial Sequence
  Description of Artificial Sequence: Synthetic oligonucleotide
  Target: AGXT; (-) strand; PAM type: NRG; PAM sequence: GAG
gcataggggaccttccattg

SEQ ID NO: 9577 - DNA, 20 bp, Artificial Sequence
  Description of Artificial Sequence: Synthetic oligonucleotide
  Target: AGXT; (-) strand; PAM type: NRG; PAM sequence: TGG
gagcataggggaccttccat

SEQ ID NO: 9578 - DNA, 20 bp, Artificial Sequence
  Description of Artificial Sequence: Synthetic oligonucleotide
  Target: AGXT; (-) strand; PAM type: NRG; PAM sequence: GGG
ctggctggatgggagcatag

SEQ ID NO: 9579 - DNA, 20 bp, Artificial Sequence
  Description of Artificial Sequence: Synthetic oligonucleotide
  Target: AGXT; (-) strand; PAM type: NRG; PAM sequence: GGG
actggctggatgggagcata

SEQ ID NO: 9580 - DNA, 20 bp, Artificial Sequence
  Description of Artificial Sequence: Synthetic oligonucleotide
  Target: AGXT; (-) strand; PAM type: NRG; PAM sequence: AGG
cactggctggatgggagcat

SEQ ID NO: 9581 - DNA, 20 bp, Artificial Sequence
  Description of Artificial Sequence: Synthetic oligonucleotide
  Target: AGXT; (-) strand; PAM type: NRG; PAM sequence: TAG
gcactggctggatgggagca

SEQ ID NO: 9582 - DNA, 20 bp, Artificial Sequence
  Description of Artificial Sequence: Synthetic oligonucleotide
  Target: AGXT; (-) strand; PAM type: NRG; PAM sequence: GAG
ggtgggcactggctggatgg

SEQ ID NO: 9583 - DNA, 20 bp, Artificial Sequence
  Description of Artificial Sequence: Synthetic oligonucleotide
  Target: AGXT; (-) strand; PAM type: NRG; PAM sequence: GGG
ggggtgggcactggctggat

SEQ ID NO: 9584 - DNA, 20 bp, Artificial Sequence
  Description of Artificial Sequence: Synthetic oligonucleotide
  Target: AGXT; (-) strand; PAM type: NRG; PAM sequence: TGG
aggggtgggcactggctgga

SEQ ID NO: 9585 - DNA, 20 bp, Artificial Sequence
  Description of Artificial Sequence: Synthetic oligonucleotide
  Target: AGXT; (-) strand; PAM type: NRG; PAM sequence: TGG
gttgaggggtgggcactggc

SEQ ID NO: 9586 - DNA, 20 bp, Artificial Sequence
  Description of Artificial Sequence: Synthetic oligonucleotide
  Target: AGXT; (-) strand; PAM type: NRG; PAM sequence: TGG
ggcagttgaggggtgggcac

SEQ ID NO: 9587 - DNA, 20 bp, Artificial Sequence
  Description of Artificial Sequence: Synthetic oligonucleotide
  Target: AGXT; (-) strand; PAM type: NRG; PAM sequence: GGG
aagtcaggcagttgaggggt

SEQ ID NO: 9588 - DNA, 20 bp, Artificial Sequence
  Description of Artificial Sequence: Synthetic oligonucleotide
  Target: AGXT; (-) strand; PAM type: NRG; PAM sequence: TGG
gaagtcaggcagttgagggg

SEQ ID NO: 9589 - DNA, 20 bp, Artificial Sequence
  Description of Artificial Sequence: Synthetic oligonucleotide
  Target: AGXT; (-) strand; PAM type: NRG; PAM sequence: GGG
acagaagtcaggcagttgag

SEQ ID NO: 9590 - DNA, 20 bp, Artificial Sequence
  Description of Artificial Sequence: Synthetic oligonucleotide
  Target: AGXT; (-) strand; PAM type: NRG; PAM sequence: GGG
cacagaagtcaggcagttga

SEQ ID NO: 9591 - DNA, 20 bp, Artificial Sequence
  Description of Artificial Sequence: Synthetic oligonucleotide
  Target: AGXT; (-) strand; PAM type: NRG; PAM sequence: AGG
tcacagaagtcaggcagttg

SEQ ID NO: 9592 - DNA, 20 bp, Artificial Sequence
  Description of Artificial Sequence: Synthetic oligonucleotide
  Target: AGXT; (-) strand; PAM type: NRG; PAM sequence: GAG
gtcacagaagtcaggcagtt

SEQ ID NO: 9593 - DNA, 20 bp, Artificial Sequence
  Description of Artificial Sequence: Synthetic oligonucleotide
  Target: AGXT; (-) strand; PAM type: NRG; PAM sequence: CAG
ctatggtcacagaagtcagg

SEQ ID NO: 9594 - DNA, 20 bp, Artificial Sequence
  Description of Artificial Sequence: Synthetic oligonucleotide
  Target: AGXT; (-) strand; PAM type: NRG; PAM sequence: AGG
gatctatggtcacagaagtc

SEQ ID NO: 9595 - DNA, 20 bp, Artificial Sequence
  Description of Artificial Sequence: Synthetic oligonucleotide
  Target: AGXT; (-) strand; PAM type: NRG; PAM sequence: CAG
tgatctatggtcacagaagt

SEQ ID NO: 9596 - DNA, 20 bp, Artificial Sequence
  Description of Artificial Sequence: Synthetic oligonucleotide
  Target: AGXT; (-) strand; PAM type: NRG; PAM sequence: AAG
aggctgatctatggtcacag

SEQ ID NO: 9597 - DNA, 20 bp, Artificial Sequence
  Description of Artificial Sequence: Synthetic oligonucleotide
  Target: AGXT; (-) strand; PAM type: NRG; PAM sequence: CAG
gccaggctgatctatggtca

SEQ ID NO: 9598 - DNA, 20 bp, Artificial Sequence
  Description of Artificial Sequence: Synthetic oligonucleotide
  Target: AGXT; (-) strand; PAM type: NRG; PAM sequence: TGG
aaatatgccaggctgatcta

SEQ ID NO: 9599 - DNA, 20 bp, Artificial Sequence
  Description of Artificial Sequence: Synthetic oligonucleotide
  Target: AGXT; (-) strand; PAM type: NRG; PAM sequence: AGG
taaataaattcaaatatgcc

SEQ ID NO: 9600 - DNA, 20 bp, Artificial Sequence
  Description of Artificial Sequence: Synthetic oligonucleotide
  Target: AGXT; (-) strand; PAM type: NRG; PAM sequence: CAG
ataaataaattcaaatatgc

SEQ ID NO: 9601 - DNA, 20 bp, Artificial Sequence
  Description of Artificial Sequence: Synthetic oligonucleotide
  Target: AGXT; (-) strand; PAM type: NRG; PAM sequence: GAG
cactccagcctgggcaacaa

SEQ ID NO: 9602 - DNA, 20 bp, Artificial Sequence
  Description of Artificial Sequence: Synthetic oligonucleotide
  Target: AGXT; (-) strand; PAM type: NRG; PAM sequence: AAG
tgcactccagcctgggcaac

SEQ ID NO: 9603 - DNA, 20 bp, Artificial Sequence
  Description of Artificial Sequence: Synthetic oligonucleotide
  Target: AGXT; (-) strand; PAM type: NRG; PAM sequence: GGG
gtgccactgcactccagcct

SEQ ID NO: 9604 - DNA, 20 bp, Artificial Sequence
  Description of Artificial Sequence: Synthetic oligonucleotide
  Target: AGXT; (-) strand; PAM type: NRG; PAM sequence: TGG
cgtgccactgcactccagcc

SEQ ID NO: 9605 - DNA, 20 bp, Artificial Sequence
  Description of Artificial Sequence: Synthetic oligonucleotide
  Target: AGXT; (-) strand; PAM type: NRG; PAM sequence: CAG
gagatcgtgccactgcactc

SEQ ID NO: 9606 - DNA, 20 bp, Artificial Sequence
  Description of Artificial Sequence: Synthetic oligonucleotide
  Target: AGXT; (-) strand; PAM type: NRG; PAM sequence: GAG
ggcggaggttgtagtgagct

SEQ ID NO: 9607 - DNA, 20 bp, Artificial Sequence
  Description of Artificial Sequence: Synthetic oligonucleotide
  Target: AGXT; (-) strand; PAM type: NRG; PAM sequence: GAG
cgggaggcggaggttgtagt

SEQ ID NO: 9608 - DNA, 20 bp, Artificial Sequence
  Description of Artificial Sequence: Synthetic oligonucleotide
  Target: AGXT; (-) strand; PAM type: NRG; PAM sequence: TAG
aacccgggaggcggaggttg

SEQ ID NO: 9609 - DNA, 20 bp, Artificial Sequence
  Description of Artificial Sequence: Synthetic oligonucleotide
  Target: AGXT; (-) strand; PAM type: NRG; PAM sequence: AGG
cgcttgaacccgggaggcgg

SEQ ID NO: 9610 - DNA, 20 bp, Artificial Sequence
  Description of Artificial Sequence: Synthetic oligonucleotide
  Target: AGXT; (-) strand; PAM type: NRG; PAM sequence: GAG
tcgcttgaacccgggaggcg

SEQ ID NO: 9611 - DNA, 20 bp, Artificial Sequence
  Description of Artificial Sequence: Synthetic oligonucleotide
  Target: AGXT; (-) strand; PAM type: NRG; PAM sequence: CGG
aatcgcttgaacccgggagg

SEQ ID NO: 9612 - DNA, 20 bp, Artificial Sequence
  Description of Artificial Sequence: Synthetic oligonucleotide
  Target: AGXT; (-) strand; PAM type: NRG; PAM sequence: AGG
gagaatcgcttgaacccggg

SEQ ID NO: 9613 - DNA, 20 bp, Artificial Sequence
  Description of Artificial Sequence: Synthetic oligonucleotide
  Target: AGXT; (-) strand; PAM type: NRG; PAM sequence: GAG
ggagaatcgcttgaacccgg

SEQ ID NO: 9614 - DNA, 20 bp, Artificial Sequence
  Description of Artificial Sequence: Synthetic oligonucleotide
  Target: AGXT; (-) strand; PAM type: NRG; PAM sequence: GGG
caggagaatcgcttgaaccc

SEQ ID NO: 9615 - DNA, 20 bp, Artificial Sequence
  Description of Artificial Sequence: Synthetic oligonucleotide
  Target: AGXT; (-) strand; PAM type: NRG; PAM sequence: CGG
gcaggagaatcgcttgaacc

SEQ ID NO: 9616 - DNA, 20 bp, Artificial Sequence
  Description of Artificial Sequence: Synthetic oligonucleotide
  Target: AGXT; (-) strand; PAM type: NRG; PAM sequence: GAG
taatccggagcctgaggcag

SEQ ID NO: 9617 - DNA, 20 bp, Artificial Sequence
  Description of Artificial Sequence: Synthetic oligonucleotide
  Target: AGXT; (-) strand; PAM type: NRG; PAM sequence: AGG
gctaatccggagcctgaggc

SEQ ID NO: 9618 - DNA, 20 bp, Artificial Sequence
  Description of Artificial Sequence: Synthetic oligonucleotide
  Target: AGXT; (-) strand; PAM type: NRG; PAM sequence: CAG
agctaatccggagcctgagg

SEQ ID NO: 9619 - DNA, 20 bp, Artificial Sequence
  Description of Artificial Sequence: Synthetic oligonucleotide
  Target: AGXT; (-) strand; PAM type: NRG; PAM sequence: AGG
cccagctaatccggagcctg

SEQ ID NO: 9620 - DNA, 20 bp, Artificial Sequence
  Description of Artificial Sequence: Synthetic oligonucleotide
  Target: AGXT; (-) strand; PAM type: NRG; PAM sequence: GAG
tcccagctaatccggagcct

SEQ ID NO: 9621 - DNA, 20 bp, Artificial Sequence
  Description of Artificial Sequence: Synthetic oligonucleotide
  Target: AGXT; (-) strand; PAM type: NRG; PAM sequence: GAG
ctgtagtcccagctaatccg

SEQ ID NO: 9622 - DNA, 20 bp, Artificial Sequence
  Description of Artificial Sequence: Synthetic oligonucleotide
  Target: AGXT; (-) strand; PAM type: NRG; PAM sequence: CGG
acctgtagtcccagctaatc

SEQ ID NO: 9623 - DNA, 20 bp, Artificial Sequence
  Description of Artificial Sequence: Synthetic oligonucleotide
  Target: AGXT; (-) strand; PAM type: NRG; PAM sequence: CAG
gtggtgcacacctgtagtcc

SEQ ID NO: 9624 - DNA, 20 bp, Artificial Sequence
  Description of Artificial Sequence: Synthetic oligonucleotide
  Target: AGXT; (-) strand; PAM type: NRG; PAM sequence: TAG
ggcatggtggtgcacacctg

SEQ ID NO: 9625 - DNA, 20 bp, Artificial Sequence
  Description of Artificial Sequence: Synthetic oligonucleotide
  Target: AGXT; (-) strand; PAM type: NRG; PAM sequence: TGG
caaaaattagccgggcatgg

SEQ ID NO: 9626 - DNA, 20 bp, Artificial Sequence
  Description of Artificial Sequence: Synthetic oligonucleotide
  Target: AGXT; (-) strand; PAM type: NRG; PAM sequence: TGG
atacaaaaattagccgggca

SEQ ID NO: 9627 - DNA, 20 bp, Artificial Sequence
  Description of Artificial Sequence: Synthetic oligonucleotide
  Target: AGXT; (-) strand; PAM type: NRG; PAM sequence: GGG
taaaaatacaaaaattagcc

SEQ ID NO: 9628 - DNA, 20 bp, Artificial Sequence
  Description of Artificial Sequence: Synthetic oligonucleotide
  Target: AGXT; (-) strand; PAM type: NRG; PAM sequence: CGG
ctaaaaatacaaaaattagc

SEQ ID NO: 9629 - DNA, 20 bp, Artificial Sequence
  Description of Artificial Sequence: Synthetic oligonucleotide
  Target: AGXT; (-) strand; PAM type: NRG; PAM sequence: TAG
tgtactaaaaatacaaaaat

SEQ ID NO: 9630 - DNA, 20 bp, Artificial Sequence
  Description of Artificial Sequence: Synthetic oligonucleotide
  Target: AGXT; (-) strand; PAM type: NRG; PAM sequence: TAG
cgagaccagcctggccaata

SEQ ID NO: 9631 - DNA, 20 bp, Artificial Sequence
  Description of Artificial Sequence: Synthetic oligonucleotide
  Target: AGXT; (-) strand; PAM type: NRG; PAM sequence: TGG
tcaggagttcgagaccagcc

SEQ ID NO: 9632 - DNA, 20 bp, Artificial Sequence
  Description of Artificial Sequence: Synthetic oligonucleotide
  Target: AGXT; (-) strand; PAM type: NRG; PAM sequence: CAG
tgaggtcaggagttcgagac

SEQ ID NO: 9633 - DNA, 20 bp, Artificial Sequence
  Description of Artificial Sequence: Synthetic oligonucleotide
  Target: AGXT; (-) strand; PAM type: NRG; PAM sequence: GAG
tcacttgaggtcaggagttc

SEQ ID NO: 9634 - DNA, 20 bp, Artificial Sequence
  Description of Artificial Sequence: Synthetic oligonucleotide
  Target: AGXT; (-) strand; PAM type: NRG; PAM sequence: GAG
ggtggatcacttgaggtcag

SEQ ID NO: 9635 - DNA, 20 bp, Artificial Sequence
  Description of Artificial Sequence: Synthetic oligonucleotide
  Target: AGXT; (-) strand; PAM type: NRG; PAM sequence: AGG
caggtggatcacttgaggtc

SEQ ID NO: 9636 - DNA, 20 bp, Artificial Sequence
  Description of Artificial Sequence: Synthetic oligonucleotide
  Target: AGXT; (-) strand; PAM type: NRG; PAM sequence: CAG
gcaggtggatcacttgaggt

SEQ ID NO: 9637 - DNA, 20 bp, Artificial Sequence
  Description of Artificial Sequence: Synthetic oligonucleotide
  Target: AGXT; (-) strand; PAM type: NRG; PAM sequence: AGG
cgaggcaggtggatcacttg

SEQ ID NO: 9638 - DNA, 20 bp, Artificial Sequence
  Description of Artificial Sequence: Synthetic oligonucleotide
  Target: AGXT; (-) strand; PAM type: NRG; PAM sequence: GAG
ccgaggcaggtggatcactt

SEQ ID NO: 9639 - DNA, 20 bp, Artificial Sequence
  Description of Artificial Sequence: Synthetic oligonucleotide
  Target: AGXT; (-) strand; PAM type: NRG; PAM sequence: TGG
ctttgggaggccgaggcagg

SEQ ID NO: 9640 - DNA, 20 bp, Artificial Sequence
  Description of Artificial Sequence: Synthetic oligonucleotide
  Target: AGXT; (-) strand; PAM type: NRG; PAM sequence: AGG
gcactttgggaggccgaggc

SEQ ID NO: 9641 - DNA, 20 bp, Artificial Sequence
  Description of Artificial Sequence: Synthetic oligonucleotide
  Target: AGXT; (-) strand; PAM type: NRG; PAM sequence: CAG
agcactttgggaggccgagg

SEQ ID NO: 9642 - DNA, 20 bp, Artificial Sequence
  Description of Artificial Sequence: Synthetic oligonucleotide
  Target: AGXT; (-) strand; PAM type: NRG; PAM sequence: AGG
cccagcactttgggaggccg

SEQ ID NO: 9643 - DNA, 20 bp, Artificial Sequence
  Description of Artificial Sequence: Synthetic oligonucleotide
  Target: AGXT; (-) strand; PAM type: NRG; PAM sequence: GAG
tcccagcactttgggaggcc

SEQ ID NO: 9644 - DNA, 20 bp, Artificial Sequence
  Description of Artificial Sequence: Synthetic oligonucleotide
  Target: AGXT; (-) strand; PAM type: NRG; PAM sequence: AGG
tgtaatcccagcactttggg

SEQ ID NO: 9645 - DNA, 20 bp, Artificial Sequence
  Description of Artificial Sequence: Synthetic oligonucleotide
  Target: AGXT; (-) strand; PAM type: NRG; PAM sequence: GAG
ttgtaatcccagcactttgg

SEQ ID NO: 9646 - DNA, 20 bp, Artificial Sequence
  Description of Artificial Sequence: Synthetic oligonucleotide
  Target: AGXT; (-) strand; PAM type: NRG; PAM sequence: GGG
gcttgtaatcccagcacttt

SEQ ID NO: 9647 - DNA, 20 bp, Artificial Sequence
  Description of Artificial Sequence: Synthetic oligonucleotide
  Target: AGXT; (-) strand; PAM type: NRG; PAM sequence: TGG
cgcttgtaatcccagcactt

SEQ ID NO: 9648 - DNA, 20 bp, Artificial Sequence
  Description of Artificial Sequence: Synthetic oligonucleotide
  Target: AGXT; (-) strand; PAM type: NRG; PAM sequence: CAG
gtggctcacgcttgtaatcc

SEQ ID NO: 9649 - DNA, 20 bp, Artificial Sequence
  Description of Artificial Sequence: Synthetic oligonucleotide
  Target: AGXT; (-) strand; PAM type: NRG; PAM sequence: TGG
tcaactatggctgggcacag

SEQ ID NO: 9650 - DNA, 20 bp, Artificial Sequence
  Description of Artificial Sequence: Synthetic oligonucleotide
  Target: AGXT; (-) strand; PAM type: NRG; PAM sequence: CAG
aattcaactatggctgggca

SEQ ID NO: 9651 - DNA, 20 bp, Artificial Sequence
  Description of Artificial Sequence: Synthetic oligonucleotide
  Target: AGXT; (-) strand; PAM type: NRG; PAM sequence: GGG
catgaaattcaactatggct

SEQ ID NO: 9652 - DNA, 20 bp, Artificial Sequence
  Description of Artificial Sequence: Synthetic oligonucleotide
  Target: AGXT; (-) strand; PAM type: NRG; PAM sequence: TGG
ccatgaaattcaactatggc

SEQ ID NO: 9653 - DNA, 20 bp, Artificial Sequence
  Description of Artificial Sequence: Synthetic oligonucleotide
  Target: AGXT; (-) strand; PAM type: NRG; PAM sequence: TGG
ctgaccatgaaattcaacta

SEQ ID NO: 9654 - DNA, 20 bp, Artificial Sequence
  Description of Artificial Sequence: Synthetic oligonucleotide
  Target: AGXT; (-) strand; PAM type: NRG; PAM sequence: AGG
gaaagaagctggcacagtgg

SEQ ID NO: 9655 - DNA, 20 bp, Artificial Sequence
  Description of Artificial Sequence: Synthetic oligonucleotide
  Target: AGXT; (-) strand; PAM type: NRG; PAM sequence: GAG
tgaaagaagctggcacagtg

SEQ ID NO: 9656 - DNA, 20 bp, Artificial Sequence
  Description of Artificial Sequence: Synthetic oligonucleotide
  Target: AGXT; (-) strand; PAM type: NRG; PAM sequence: TGG
agtgaaagaagctggcacag

SEQ ID NO: 9657 - DNA, 20 bp, Artificial Sequence
  Description of Artificial Sequence: Synthetic oligonucleotide
  Target: AGXT; (-) strand; PAM type: NRG; PAM sequence: CAG
gtaagtgaaagaagctggca

SEQ ID NO: 9658 - DNA, 20 bp, Artificial Sequence
  Description of Artificial Sequence: Synthetic oligonucleotide
  Target: AGXT; (-) strand; PAM type: NRG; PAM sequence: TGG
aaacagtaagtgaaagaagc

SEQ ID NO: 9659 - DNA, 20 bp, Artificial Sequence
  Description of Artificial Sequence: Synthetic oligonucleotide
  Target: AGXT; (-) strand; PAM type: NRG; PAM sequence: AAG
tcaaaaacagtaagtgaaag

SEQ ID NO: 9660 - DNA, 20 bp, Artificial Sequence
  Description of Artificial Sequence: Synthetic oligonucleotide
  Target: AGXT; (-) strand; PAM type: NRG; PAM sequence: AAG
gtgtcaaaaacagtaagtga

SEQ ID NO: 9661 - DNA, 20 bp, Artificial Sequence
  Description of Artificial Sequence: Synthetic oligonucleotide
  Target: AGXT; (-) strand; PAM type: NRG; PAM sequence: AAG
atgtgagtgtcaaaaacagt

SEQ ID NO: 9662 - DNA, 20 bp, Artificial Sequence
  Description of Artificial Sequence: Synthetic oligonucleotide
  Target: AGXT; (-) strand; PAM type: NRG; PAM sequence: CAG
gtacatgtgagtgtcaaaaa

SEQ ID NO: 9663 - DNA, 20 bp, Artificial Sequence
  Description of Artificial Sequence: Synthetic oligonucleotide
  Target: AGXT; (-) strand; PAM type: NRG; PAM sequence: GAG
gcgcccacgacggtacatgt

SEQ ID NO: 9664 - DNA, 20 bp, Artificial Sequence
  Description of Artificial Sequence: Synthetic oligonucleotide
  Target: AGXT; (-) strand; PAM type: NRG; PAM sequence: CGG
agacacaccggcgcccacga

SEQ ID NO: 9665 - DNA, 20 bp, Artificial Sequence
  Description of Artificial Sequence: Synthetic oligonucleotide
  Target: AGXT; (-) strand; PAM type: NRG; PAM sequence: CGG
actcagcaacaaagacacac

SEQ ID NO: 9666 - DNA, 20 bp, Artificial Sequence
  Description of Artificial Sequence: Synthetic oligonucleotide
  Target: AGXT; (-) strand; PAM type: NRG; PAM sequence: AAG
cgggacggcactcagcaaca

SEQ ID NO: 9667 - DNA, 20 bp, Artificial Sequence
  Description of Artificial Sequence: Synthetic oligonucleotide
  Target: AGXT; (-) strand; PAM type: NRG; PAM sequence: CAG
ccatatgacgggacggcact

SEQ ID NO: 9668 - DNA, 20 bp, Artificial Sequence
  Description of Artificial Sequence: Synthetic oligonucleotide
  Target: AGXT; (-) strand; PAM type: NRG; PAM sequence: CGG
cgcacgtccatatgacggga

SEQ ID NO: 9669 - DNA, 20 bp, Artificial Sequence
  Description of Artificial Sequence: Synthetic oligonucleotide
  Target: AGXT; (-) strand; PAM type: NRG; PAM sequence: GGG
acgacgcacgtccatatgac

SEQ ID NO: 9670 - DNA, 20 bp, Artificial Sequence
  Description of Artificial Sequence: Synthetic oligonucleotide
  Target: AGXT; (-) strand; PAM type: NRG; PAM sequence: CGG
cacgacgcacgtccatatga

SEQ ID NO: 9671 - DNA, 20 bp, Artificial Sequence
  Description of Artificial Sequence: Synthetic oligonucleotide
  Target: AGXT; (-) strand; PAM type: NRG; PAM sequence: CGG
cactcagcaacaagacacac

SEQ ID NO: 9672 - DNA, 20 bp, Artificial Sequence
  Description of Artificial Sequence: Synthetic oligonucleotide
  Target: AGXT; (-) strand; PAM type: NRG; PAM sequence: AAG
acgggacggcactcagcaac

SEQ ID NO: 9673 - DNA, 20 bp, Artificial Sequence
  Description of Artificial Sequence: Synthetic oligonucleotide
  Target: AGXT; (-) strand; PAM type: NRG; PAM sequence: CAG
ccatatgacgggacggcact

SEQ ID NO: 9674 - DNA, 20 bp, Artificial Sequence
  Description of Artificial Sequence: Synthetic oligonucleotide
  Target: AGXT; (-) strand; PAM type: NRG; PAM sequence: CGG
gaggtgtccatatgacggga

SEQ ID NO: 9675 - DNA, 20 bp, Artificial Sequence
  Description of Artificial Sequence: Synthetic oligonucleotide
  Target: AGXT; (-) strand; PAM type: NRG; PAM sequence: GGG
tcatgaggtgtccatatgac

SEQ ID NO: 9676 - DNA, 20 bp, Artificial Sequence
  Description of Artificial Sequence: Synthetic oligonucleotide
  Target: AGXT; (-) strand; PAM type: NRG; PAM sequence: CGG
atcatgaggtgtccatatga

SEQ ID NO: 9677 - DNA, 20 bp, Artificial Sequence
  Description of Artificial Sequence: Synthetic oligonucleotide
  Target: AGXT; (-) strand; PAM type: NRG; PAM sequence: AGG
tgatgaaccaacaaatcatg

SEQ ID NO: 9678 - DNA, 20 bp, Artificial Sequence
  Description of Artificial Sequence: Synthetic oligonucleotide
  Target: AGXT; (-) strand; PAM type: NRG; PAM sequence: GAG
gtgatgaaccaacaaatcat

SEQ ID NO: 9679 - DNA, 20 bp, Artificial Sequence
  Description of Artificial Sequence: Synthetic oligonucleotide
  Target: AGXT; (-) strand; PAM type: NRG; PAM sequence: TGG
ataacccagatgctcaacta

SEQ ID NO: 9680 - DNA, 20 bp, Artificial Sequence
  Description of Artificial Sequence: Synthetic oligonucleotide
  Target: AGXT; (-) strand; PAM type: NRG; PAM sequence: CAG
gccccaaaatagaaataacc

SEQ ID NO: 9681 - DNA, 20 bp, Artificial Sequence
  Description of Artificial Sequence: Synthetic oligonucleotide
  Target: AGXT; (-) strand; PAM type: NRG; PAM sequence: TAG
tattcataacagccccaaaa

SEQ ID NO: 9682 - DNA, 20 bp, Artificial Sequence
  Description of Artificial Sequence: Synthetic oligonucleotide
  Target: AGXT; (-) strand; PAM type: NRG; PAM sequence: CAG
cactacctccgtattcataa

SEQ ID NO: 9683 - DNA, 20 bp, Artificial Sequence
  Description of Artificial Sequence: Synthetic oligonucleotide
  Target: AGXT; (-) strand; PAM type: NRG; PAM sequence: AAG
ggccacacgaaggcttgagt

SEQ ID NO: 9684 - DNA, 20 bp, Artificial Sequence
  Description of Artificial Sequence: Synthetic oligonucleotide
  Target: AGXT; (-) strand; PAM type: NRG; PAM sequence: GAG
atatggccacacgaaggctt

SEQ ID NO: 9685 - DNA, 20 bp, Artificial Sequence
  Description of Artificial Sequence: Synthetic oligonucleotide
  Target: AGXT; (-) strand; PAM type: NRG; PAM sequence: AGG
gaaaatatatggccacacga

SEQ ID NO: 9686 - DNA, 20 bp, Artificial Sequence
  Description of Artificial Sequence: Synthetic oligonucleotide
  Target: AGXT; (-) strand; PAM type: NRG; PAM sequence: AAG
tgaaaatatatggccacacg

SEQ ID NO: 9687 - DNA, 20 bp, Artificial Sequence
  Description of Artificial Sequence: Synthetic oligonucleotide
  Target: AGXT; (-) strand; PAM type: NRG; PAM sequence: TGG
ccaagaaaaatgaaaatata

SEQ ID NO: 9688 - DNA, 20 bp, Artificial Sequence
  Description of Artificial Sequence: Synthetic oligonucleotide
  Target: AGXT; (-) strand; PAM type: NRG; PAM sequence: AAG
ccactcctagttatttatcc

SEQ ID NO: 9689 - DNA, 20 bp, Artificial Sequence
  Description of Artificial Sequence: Synthetic oligonucleotide
  Target: AGXT; (-) strand; PAM type: NRG; PAM sequence: TAG
tgaccctgcaattccactcc

SEQ ID NO: 9690 - DNA, 20 bp, Artificial Sequence
  Description of Artificial Sequence: Synthetic oligonucleotide
  Target: AGXT; (-) strand; PAM type: NRG; PAM sequence: AAG
tggcagtctcgtataaggtt

SEQ ID NO: 9691 - DNA, 20 bp, Artificial Sequence
  Description of Artificial Sequence: Synthetic oligonucleotide
  Target: AGXT; (-) strand; PAM type: NRG; PAM sequence: AGG
tttcgtggcagtctcgtata

SEQ ID NO: 9692 - DNA, 20 bp, Artificial Sequence
  Description of Artificial Sequence: Synthetic oligonucleotide
  Target: AGXT; (-) strand; PAM type: NRG; PAM sequence: AAG
atttcgtggcagtctcgtat

SEQ ID NO: 9693 - DNA, 20 bp, Artificial Sequence
  Description of Artificial Sequence: Synthetic oligonucleotide
  Target: AGXT; (-) strand; PAM type: NRG; PAM sequence: CAG
cacttcggagaatttcgtgg

SEQ ID NO: 9694 - DNA, 20 bp, Artificial Sequence
  Description of Artificial Sequence: Synthetic oligonucleotide
  Target: AGXT; (-) strand; PAM type: NRG; PAM sequence: TGG
agccacttcggagaatttcg

SEQ ID NO: 9695 - DNA, 20 bp, Artificial Sequence
  Description of Artificial Sequence: Synthetic oligonucleotide
  Target: AGXT; (-) strand; PAM type: NRG; PAM sequence: GAG
aacatggaagagccacttcg

SEQ ID NO: 9696 - DNA, 20 bp, Artificial Sequence
  Description of Artificial Sequence: Synthetic oligonucleotide
  Target: AGXT; (-) strand; PAM type: NRG; PAM sequence: CGG
gaaacatggaagagccactt

SEQ ID NO: 9697 - DNA, 20 bp, Artificial Sequence
  Description of Artificial Sequence: Synthetic oligonucleotide
  Target: AGXT; (-) strand; PAM type: NRG; PAM sequence: GAG
tgcgggaatgaaacatggaa

SEQ ID NO: 9698 - DNA, 20 bp, Artificial Sequence
  Description of Artificial Sequence: Synthetic oligonucleotide
  Target: AGXT; (-) strand; PAM type: NRG; PAM sequence: AAG
gctgcgggaatgaaacatgg

SEQ ID NO: 9699 - DNA, 20 bp, Artificial Sequence
  Description of Artificial Sequence: Synthetic oligonucleotide
  Target: AGXT; (-) strand; PAM type: NRG; PAM sequence: TGG
gtagctgcgggaatgaaaca

SEQ ID NO: 9700 - DNA, 20 bp, Artificial Sequence
  Description of Artificial Sequence: Synthetic oligonucleotide
  Target: AGXT; (-) strand; PAM type: NRG; PAM sequence: GGG
accctggacgctgtagctgc

SEQ ID NO: 9701 - DNA, 20 bp, Artificial Sequence
  Description of Artificial Sequence: Synthetic oligonucleotide
  Target: AGXT; (-) strand; PAM type: NRG; PAM sequence: CGG
caccctggacgctgtagctg

SEQ ID NO: 9702 - DNA, 20 bp, Artificial Sequence
  Description of Artificial Sequence: Synthetic oligonucleotide
  Target: AGXT; (-) strand; PAM type: NRG; PAM sequence: TAG
gtggagcaccctggacgctg

SEQ ID NO: 9703 - DNA, 20 bp, Artificial Sequence
  Description of Artificial Sequence: Synthetic oligonucleotide
  Target: AGXT; (-) strand; PAM type: NRG; PAM sequence: TGG
ggtgaggacgtggagcaccc

SEQ ID NO: 9704 - DNA, 20 bp, Artificial Sequence
  Description of Artificial Sequence: Synthetic oligonucleotide
  Target: AGXT; (-) strand; PAM type: NRG; PAM sequence: GAG
ggagtgtgggtgaggacgtg

SEQ ID NO: 9705 - DNA, 20 bp, Artificial Sequence
  Description of Artificial Sequence: Synthetic oligonucleotide
  Target: AGXT; (-) strand; PAM type: NRG; PAM sequence: TGG
atggagtgtgggtgaggacg

SEQ ID NO: 9706 - DNA, 20 bp, Artificial Sequence
  Description of Artificial Sequence: Synthetic oligonucleotide
  Target: AGXT; (-) strand; PAM type: NRG; PAM sequence: AGG
gacaacatggagtgtgggtg

SEQ ID NO: 9707 - DNA, 20 bp, Artificial Sequence
  Description of Artificial Sequence: Synthetic oligonucleotide
  Target: AGXT; (-) strand; PAM type: NRG; PAM sequence: GAG
agacaacatggagtgtgggt

SEQ ID NO: 9708 - DNA, 20 bp, Artificial Sequence
  Description of Artificial Sequence: Synthetic oligonucleotide
  Target: AGXT; (-) strand; PAM type: NRG; PAM sequence: GGG
aaaaagacaacatggagtgt

SEQ ID NO: 9709 - DNA, 20 bp, Artificial Sequence
  Description of Artificial Sequence: Synthetic oligonucleotide
  Target: AGXT; (-) strand; PAM type: NRG; PAM sequence: TGG
aaaaaagacaacatggagtg

SEQ ID NO: 9710 - DNA, 20 bp, Artificial Sequence
  Description of Artificial Sequence: Synthetic oligonucleotide
  Target: AGXT; (-) strand; PAM type: NRG; PAM sequence: GAG
tagcaaaaaaagacaacatg

SEQ ID NO: 9711 - DNA, 20 bp, Artificial Sequence
  Description of Artificial Sequence: Synthetic oligonucleotide
  Target: AGXT; (-) strand; PAM type: NRG; PAM sequence: TGG
cctagcaaaaaaagacaaca

SEQ ID NO: 9712 - DNA, 20 bp, Artificial Sequence
  Description of Artificial Sequence: Synthetic oligonucleotide
  Target: AGXT; (-) strand; PAM type: NRG; PAM sequence: AAG
tttacaccccctagcaaaaa

SEQ ID NO: 9713 - DNA, 20 bp, Artificial Sequence
  Description of Artificial Sequence: Synthetic oligonucleotide
  Target: AGXT; (-) strand; PAM type: NRG; PAM sequence: TAG
agacaggattttacaccccc

SEQ ID NO: 9714 - DNA, 20 bp, Artificial Sequence
  Description of Artificial Sequence: Synthetic oligonucleotide
  Target: AGXT; (-) strand; PAM type: NRG; PAM sequence: AGG
aaactaaaaccaaatcagac

SEQ ID NO: 9715 - DNA, 20 bp, Artificial Sequence
  Description of Artificial Sequence: Synthetic oligonucleotide
  Target: AGXT; (-) strand; PAM type: NRG; PAM sequence: CAG
caaactaaaaccaaatcaga

SEQ ID NO: 9716 - DNA, 20 bp, Artificial Sequence
  Description of Artificial Sequence: Synthetic oligonucleotide
  Target: AGXT; (-) strand; PAM type: NRG; PAM sequence: CAG
aatgcaaactaaaaccaaat

SEQ ID NO: 9717 - DNA, 20 bp, Artificial Sequence
  Description of Artificial Sequence: Synthetic oligonucleotide
  Target: AGXT; (-) strand; PAM type: NRG; PAM sequence: GGG
ctcaacatcaataggcatca

SEQ ID NO: 9718 - DNA, 20 bp, Artificial Sequence
  Description of Artificial Sequence: Synthetic oligonucleotide
  Target: AGXT; (-) strand; PAM type: NRG; PAM sequence: AGG
gctcaacatcaataggcatc

SEQ ID NO: 9719 - DNA, 20 bp, Artificial Sequence
  Description of Artificial Sequence: Synthetic oligonucleotide
  Target: AGXT; (-) strand; PAM type: NRG; PAM sequence: CAG
tgctcaacatcaataggcat

SEQ ID NO: 9720 - DNA, 20 bp, Artificial Sequence
  Description of Artificial Sequence: Synthetic oligonucleotide
  Target: AGXT; (-) strand; PAM type: NRG; PAM sequence: AGG
agaagttgctcaacatcaat

SEQ ID NO: 9721 - DNA, 20 bp, Artificial Sequence
  Description of Artificial Sequence: Synthetic oligonucleotide
  Target: AGXT; (-) strand; PAM type: NRG; PAM sequence: TAG
gagaagttgctcaacatcaa

SEQ ID NO: 9722 - DNA, 20 bp, Artificial Sequence
  Description of Artificial Sequence: Synthetic oligonucleotide
  Target: AGXT; (-) strand; PAM type: NRG; PAM sequence: AAG
aacggccgatagctcatgag

SEQ ID NO: 9723 - DNA, 20 bp, Artificial Sequence
  Description of Artificial Sequence: Synthetic oligonucleotide
  Target: AGXT; (-) strand; PAM type: NRG; PAM sequence: GAG
acaaacggccgatagctcat

SEQ ID NO: 9724 - DNA, 20 bp, Artificial Sequence
  Description of Artificial Sequence: Synthetic oligonucleotide
  Target: AGXT; (-) strand; PAM type: NRG; PAM sequence: TAG
gaagatctacaaacggccga

SEQ ID NO: 9725 - DNA, 20 bp, Artificial Sequence
  Description of Artificial Sequence: Synthetic oligonucleotide
  Target: AGXT; (-) strand; PAM type: NRG; PAM sequence: CGG
cttttcagaagatctacaaa

SEQ ID NO: 9726 - DNA, 20 bp, Artificial Sequence
  Description of Artificial Sequence: Synthetic oligonucleotide
  Target: AGXT; (-) strand; PAM type: NRG; PAM sequence: AAG
tttgaactgacacttttcag

SEQ ID NO: 9727 - DNA, 20 bp, Artificial Sequence
  Description of Artificial Sequence: Synthetic oligonucleotide
  Target: AGXT; (-) strand; PAM type: NRG; PAM sequence: CAG
atatttgaactgacactttt

SEQ ID NO: 9728 - DNA, 20 bp, Artificial Sequence
  Description of Artificial Sequence: Synthetic oligonucleotide
  Target: AGXT; (-) strand; PAM type: NRG; PAM sequence: AAG
gatcacacattgacaataag

SEQ ID NO: 9729 - DNA, 20 bp, Artificial Sequence
  Description of Artificial Sequence: Synthetic oligonucleotide
  Target: AGXT; (-) strand; PAM type: NRG; PAM sequence: AAG
aatgatcacacattgacaat

SEQ ID NO: 9730 - DNA, 20 bp, Artificial Sequence
  Description of Artificial Sequence: Synthetic oligonucleotide
  Target: AGXT; (-) strand; PAM type: NRG; PAM sequence: TAG
cacacgtatctgatagtatc

SEQ ID NO: 9731 - DNA, 20 bp, Artificial Sequence
  Description of Artificial Sequence: Synthetic oligonucleotide
  Target: AGXT; (-) strand; PAM type: NRG; PAM sequence: TAG
ttcatgccacacgtatctga

SEQ ID NO: 9732 - DNA, 20 bp, Artificial Sequence
  Description of Artificial Sequence: Synthetic oligonucleotide
  Target: AGXT; (-) strand; PAM type: NRG; PAM sequence: AGG
caggtaagccacagagaggg

SEQ ID NO: 9733 - DNA, 20 bp, Artificial Sequence
  Description of Artificial Sequence: Synthetic oligonucleotide
  Target: AGXT; (-) strand; PAM type: NRG; PAM sequence: GAG
acaggtaagccacagagagg

SEQ ID NO: 9734 - DNA, 20 bp, Artificial Sequence
  Description of Artificial Sequence: Synthetic oligonucleotide
  Target: AGXT; (-) strand; PAM type: NRG; PAM sequence: GGG
gaacaggtaagccacagaga

SEQ ID NO: 9735 - DNA, 20 bp, Artificial Sequence
  Description of Artificial Sequence: Synthetic oligonucleotide
  Target: AGXT; (-) strand; PAM type: NRG; PAM sequence: AGG
tgaacaggtaagccacagag

SEQ ID NO: 9736 - DNA, 20 bp, Artificial Sequence
  Description of Artificial Sequence: Synthetic oligonucleotide
  Target: AGXT; (-) strand; PAM type: NRG; PAM sequence: GAG
atgaacaggtaagccacaga

SEQ ID NO: 9737 - DNA, 20 bp, Artificial Sequence
  Description of Artificial Sequence: Synthetic oligonucleotide
  Target: AGXT; (-) strand; PAM type: NRG; PAM sequence: GAG
aaatgaacaggtaagccaca

SEQ ID NO: 9738 - DNA, 20 bp, Artificial Sequence
  Description of Artificial Sequence: Synthetic oligonucleotide
  Target: AGXT; (-) strand; PAM type: NRG; PAM sequence: CAG
gaaaatgaacaggtaagcca

SEQ ID NO: 9739 - DNA, 20 bp, Artificial Sequence
  Description of Artificial Sequence: Synthetic oligonucleotide
  Target: AGXT; (-) strand; PAM type: NRG; PAM sequence: AAG
agaaaagaaaatgaacaggt

SEQ ID NO: 9740 - DNA, 20 bp, Artificial Sequence
  Description of Artificial Sequence: Synthetic oligonucleotide
  Target: AGXT; (-) strand; PAM type: NRG; PAM sequence: AGG
aaaaagaaaagaaaatgaac

SEQ ID NO: 9741 - DNA, 20 bp, Artificial Sequence
  Description of Artificial Sequence: Synthetic oligonucleotide
  Target: AGXT; (-) strand; PAM type: NRG; PAM sequence: CAG
aaaaaagaaaagaaaatgaa

SEQ ID NO: 9742 - DNA, 20 bp, Artificial Sequence
  Description of Artificial Sequence: Synthetic oligonucleotide
  Target: AGXT; (-) strand; PAM type: NRG; PAM sequence: AAG
aagaaagaaagaaaaaagaa

SEQ ID NO: 9743 - DNA, 20 bp, Artificial Sequence
  Description of Artificial Sequence: Synthetic oligonucleotide
  Target: AGXT; (-) strand; PAM type: NRG; PAM sequence: AAG
aaaaaaagaaagaaagaaaa

SEQ ID NO: 9744 - DNA, 20 bp, Artificial Sequence
  Description of Artificial Sequence: Synthetic oligonucleotide
  Target: AGXT; (-) strand; PAM type: NRG; PAM sequence: AAG
aaaaaaaaaaaaaagaaaga

SEQ ID NO: 9745 - DNA, 20 bp, Artificial Sequence
  Description of Artificial Sequence: Synthetic oligonucleotide
  Target: AGXT; (-) strand; PAM type: NRG; PAM sequence: AAG
aaaaaaaaaaaaaaaaaaga

SEQ ID NO: 9746 - DNA, 20 bp, Artificial Sequence
  Description of Artificial Sequence: Synthetic oligonucleotide
  Target: AGXT; (-) strand; PAM type: NRG; PAM sequence: AAG
aaaaaaaaaaaaaaaaaaaa

SEQ ID NO: 9747 - DNA, 20 bp, Artificial Sequence
  Description of Artificial Sequence: Synthetic oligonucleotide
  Target: AGXT; (-) strand; PAM type: NRG; PAM sequence: GAG
ctctccagcctggacggagt

SEQ ID NO: 9748 - DNA, 20 bp, Artificial Sequence
  Description of Artificial Sequence: Synthetic oligonucleotide
  Target: AGXT; (-) strand; PAM type: NRG; PAM sequence: GAG
actgctctccagcctggacg

SEQ ID NO: 9749 - DNA, 20 bp, Artificial Sequence
  Description of Artificial Sequence: Synthetic oligonucleotide
  Target: AGXT; (-) strand; PAM type: NRG; PAM sequence: CGG
ccactgctctccagcctgga

SEQ ID NO: 9750 - DNA, 20 bp, Artificial Sequence
  Description of Artificial Sequence: Synthetic oligonucleotide
  Target: AGXT; (-) strand; PAM type: NRG; PAM sequence: TGG
cacaccactgctctccagcc

SEQ ID NO: 9751 - DNA, 20 bp, Artificial Sequence
  Description of Artificial Sequence: Synthetic oligonucleotide
  Target: AGXT; (-) strand; PAM type: NRG; PAM sequence: CAG
gagatcacaccactgctctc

SEQ ID NO: 9752 - DNA, 20 bp, Artificial Sequence
  Description of Artificial Sequence: Synthetic oligonucleotide
  Target: AGXT; (-) strand; PAM type: NRG; PAM sequence: GAG
ggtggaggttgcagtgagct

SEQ ID NO: 9753 - DNA, 20 bp, Artificial Sequence
  Description of Artificial Sequence: Synthetic oligonucleotide
  Target: AGXT; (-) strand; PAM type: NRG; PAM sequence: GAG
cgggaggtggaggttgcagt

SEQ ID NO: 9754 - DNA, 20 bp, Artificial Sequence
  Description of Artificial Sequence: Synthetic oligonucleotide
  Target: AGXT; (-) strand; PAM type: NRG; PAM sequence: CAG
aacccgggaggtggaggttg

SEQ ID NO: 9755 - DNA, 20 bp, Artificial Sequence
  Description of Artificial Sequence: Synthetic oligonucleotide
  Target: AGXT; (-) strand; PAM type: NRG; PAM sequence: AGG
ctcttgaacccgggaggtgg

SEQ ID NO: 9756 - DNA, 20 bp, Artificial Sequence
  Description of Artificial Sequence: Synthetic oligonucleotide
  Target: AGXT; (-) strand; PAM type: NRG; PAM sequence: GAG
tctcttgaacccgggaggtg

SEQ ID NO: 9757 - DNA, 20 bp, Artificial Sequence
  Description of Artificial Sequence: Synthetic oligonucleotide
  Target: AGXT; (-) strand; PAM type: NRG; PAM sequence: TGG
aatctcttgaacccgggagg

SEQ ID NO: 9758 - DNA, 20 bp, Artificial Sequence
  Description of Artificial Sequence: Synthetic oligonucleotide
  Target: AGXT; (-) strand; PAM type: NRG; PAM sequence: AGG
gagaatctcttgaacccggg

SEQ ID NO: 9759 - DNA, 20 bp, Artificial Sequence
  Description of Artificial Sequence: Synthetic oligonucleotide
  Target: AGXT; (-) strand; PAM type: NRG; PAM sequence: GAG
ggagaatctcttgaacccgg

SEQ ID NO: 9760 - DNA, 20 bp, Artificial Sequence
  Description of Artificial Sequence: Synthetic oligonucleotide
  Target: AGXT; (-) strand; PAM type: NRG; PAM sequence: GGG
caggagaatctcttgaaccc

SEQ ID NO: 9761 - DNA, 20 bp, Artificial Sequence
  Description of Artificial Sequence: Synthetic oligonucleotide
  Target: AGXT; (-) strand; PAM type: NRG; PAM sequence: CGG
gcaggagaatctcttgaacc

SEQ ID NO: 9762 - DNA, 20 bp, Artificial Sequence
  Description of Artificial Sequence: Synthetic oligonucleotide
  Target: AGXT; (-) strand; PAM type: NRG; PAM sequence: GAG
tacttgggaggctgaggcag

SEQ ID NO: 9763 - DNA, 20 bp, Artificial Sequence
  Description of Artificial Sequence: Synthetic oligonucleotide
  Target: AGXT; (-) strand; PAM type: NRG; PAM sequence: AGG
gctacttgggaggctgaggc

SEQ ID NO: 9764 - DNA, 20 bp, Artificial Sequence
  Description of Artificial Sequence: Synthetic oligonucleotide
  Target: AGXT; (-) strand; PAM type: NRG; PAM sequence: CAG
agctacttgggaggctgagg

SEQ ID NO: 9765 - DNA, 20 bp, Artificial Sequence
  Description of Artificial Sequence: Synthetic oligonucleotide
  Target: AGXT; (-) strand; PAM type: NRG; PAM sequence: AGG
cccagctacttgggaggctg

SEQ ID NO: 9766 - DNA, 20 bp, Artificial Sequence
  Description of Artificial Sequence: Synthetic oligonucleotide
  Target: AGXT; (-) strand; PAM type: NRG; PAM sequence: GAG
tcccagctacttgggaggct

SEQ ID NO: 9767 - DNA, 20 bp, Artificial Sequence
  Description of Artificial Sequence: Synthetic oligonucleotide
  Target: AGXT; (-) strand; PAM type: NRG; PAM sequence: AGG
tgtaatcccagctacttggg

SEQ ID NO: 9768 - DNA, 20 bp, Artificial Sequence
  Description of Artificial Sequence: Synthetic oligonucleotide
  Target: AGXT; (-) strand; PAM type: NRG; PAM sequence: GAG
ctgtaatcccagctacttgg

SEQ ID NO: 9769 - DNA, 20 bp, Artificial Sequence
  Description of Artificial Sequence: Synthetic oligonucleotide
  Target: AGXT; (-) strand; PAM type: NRG; PAM sequence: GGG
gcctgtaatcccagctactt

SEQ ID NO: 9770 - DNA, 20 bp, Artificial Sequence
  Description of Artificial Sequence: Synthetic oligonucleotide
  Target: AGXT; (-) strand; PAM type: NRG; PAM sequence: TGG
tgcctgtaatcccagctact

SEQ ID NO: 9771 - DNA, 20 bp, Artificial Sequence
  Description of Artificial Sequence: Synthetic oligonucleotide
  Target: AGXT; (-) strand; PAM type: NRG; PAM sequence: CAG
gtggtgcatgcctgtaatcc

SEQ ID NO: 9772 - DNA, 20 bp, Artificial Sequence
  Description of Artificial Sequence: Synthetic oligonucleotide
  Target: AGXT; (-) strand; PAM type: NRG; PAM sequence: TGG
caaaaattagccgggtgtgg

SEQ ID NO: 9773 - DNA, 20 bp, Artificial Sequence
  Description of Artificial Sequence: Synthetic oligonucleotide
  Target: AGXT; (-) strand; PAM type: NRG; PAM sequence: TGG
acacaaaaattagccgggtg

SEQ ID NO: 9774 - DNA, 20 bp, Artificial Sequence
  Description of Artificial Sequence: Synthetic oligonucleotide
  Target: AGXT; (-) strand; PAM type: NRG; PAM sequence: GGG
aaaaaacacaaaaattagcc

SEQ ID NO: 9775 - DNA, 20 bp, Artificial Sequence
  Description of Artificial Sequence: Synthetic oligonucleotide
  Target: AGXT; (-) strand; PAM type: NRG; PAM sequence: CGG
aaaaaaacacaaaaattagc

SEQ ID NO: 9776 - DNA, 20 bp, Artificial Sequence
  Description of Artificial Sequence: Synthetic oligonucleotide
  Target: AGXT; (-) strand; PAM type: NRG; PAM sequence: TAG
ctacaaaaaaacacaaaaat

SEQ ID NO: 9777 - DNA, 20 bp, Artificial Sequence
  Description of Artificial Sequence: Synthetic oligonucleotide
  Target: AGXT; (-) strand; PAM type: NRG; PAM sequence: TGG
tgagaccagcctggccaaca

SEQ ID NO: 9778 - DNA, 20 bp, Artificial Sequence
  Description of Artificial Sequence: Synthetic oligonucleotide
  Target: AGXT; (-) strand; PAM type: NRG; PAM sequence: TGG
tcaggaatttgagaccagcc

SEQ ID NO: 9779 - DNA, 20 bp, Artificial Sequence
  Description of Artificial Sequence: Synthetic oligonucleotide
  Target: AGXT; (-) strand; PAM type: NRG; PAM sequence: CAG
tgaggtcaggaatttgagac

SEQ ID NO: 9780 - DNA, 20 bp, Artificial Sequence
  Description of Artificial Sequence: Synthetic oligonucleotide
  Target: AGXT; (-) strand; PAM type: NRG; PAM sequence: GAG
tcacttgaggtcaggaattt

SEQ ID NO: 9781 - DNA, 20 bp, Artificial Sequence
  Description of Artificial Sequence: Synthetic oligonucleotide
  Target: AGXT; (-) strand; PAM type: NRG; PAM sequence: AGG
tgggtggatcacttgaggtc

SEQ ID NO: 9782 - DNA, 20 bp, Artificial Sequence
  Description of Artificial Sequence: Synthetic oligonucleotide
  Target: AGXT; (-) strand; PAM type: NRG; PAM sequence: CAG
gtgggtggatcacttgaggt

SEQ ID NO: 9783 - DNA, 20 bp, Artificial Sequence
  Description of Artificial Sequence: Synthetic oligonucleotide
  Target: AGXT; (-) strand; PAM type: NRG; PAM sequence: AGG
tgaggtgggtggatcacttg

SEQ ID NO: 9784 - DNA, 20 bp, Artificial Sequence
  Description of Artificial Sequence: Synthetic oligonucleotide
  Target: AGXT; (-) strand; PAM type: NRG; PAM sequence: GAG
ctgaggtgggtggatcactt

SEQ ID NO: 9785 - DNA, 20 bp, Artificial Sequence
  Description of Artificial Sequence: Synthetic oligonucleotide
  Target: AGXT; (-) strand; PAM type: NRG; PAM sequence: TGG
ctttgggaggctgaggtggg

SEQ ID NO: 9786 - DNA, 20 bp, Artificial Sequence
  Description of Artificial Sequence: Synthetic oligonucleotide
  Target: AGXT; (-) strand; PAM type: NRG; PAM sequence: GGG
gcactttgggaggctgaggt

SEQ ID NO: 9787 - DNA, 20 bp, Artificial Sequence
  Description of Artificial Sequence: Synthetic oligonucleotide
  Target: AGXT; (-) strand; PAM type: NRG; PAM sequence: TGG
agcactttgggaggctgagg

SEQ ID NO: 9788 - DNA, 20 bp, Artificial Sequence
  Description of Artificial Sequence: Synthetic oligonucleotide
  Target: AGXT; (-) strand; PAM type: NRG; PAM sequence: AGG
cccagcactttgggaggctg

SEQ ID NO: 9789 - DNA, 20 bp, Artificial Sequence
  Description of Artificial Sequence: Synthetic oligonucleotide
  Target: AGXT; (-) strand; PAM type: NRG; PAM sequence: GAG
tcccagcactttgggaggct

SEQ ID NO: 9790 - DNA, 20 bp, Artificial Sequence
  Description of Artificial Sequence: Synthetic oligonucleotide
  Target: AGXT; (-) strand; PAM type: NRG; PAM sequence: AGG
tgtaatcccagcactttggg

SEQ ID NO: 9791 - DNA, 20 bp, Artificial Sequence
  Description of Artificial Sequence: Synthetic oligonucleotide
  Target: AGXT; (-) strand; PAM type: NRG; PAM sequence: GAG
ctgtaatcccagcactttgg

SEQ ID NO: 9792 - DNA, 20 bp, Artificial Sequence
  Description of Artificial Sequence: Synthetic oligonucleotide
  Target: AGXT; (-) strand; PAM type: NRG; PAM sequence: GGG
gcctgtaatcccagcacttt

SEQ ID NO: 9793 - DNA, 20 bp, Artificial Sequence
  Description of Artificial Sequence: Synthetic oligonucleotide
  Target: AGXT; (-) strand; PAM type: NRG; PAM sequence: TGG
tgcctgtaatcccagcactt

SEQ ID NO: 9794 - DNA, 20 bp, Artificial Sequence
  Description of Artificial Sequence: Synthetic oligonucleotide
  Target: AGXT; (-) strand; PAM type: NRG; PAM sequence: CAG
gtggctcatgcctgtaatcc

SEQ ID NO: 9795 - DNA, 20 bp, Artificial Sequence
  Description of Artificial Sequence: Synthetic oligonucleotide
  Target: AGXT; (-) strand; PAM type: NRG; PAM sequence: TGG
aataggtaagctgggtgtgg

SEQ ID NO: 9796 - DNA, 20 bp, Artificial Sequence
  Description of Artificial Sequence: Synthetic oligonucleotide
  Target: AGXT; (-) strand; PAM type: NRG; PAM sequence: TGG
atgaataggtaagctgggtg

SEQ ID NO: 9797 - DNA, 20 bp, Artificial Sequence
  Description of Artificial Sequence: Synthetic oligonucleotide
  Target: AGXT; (-) strand; PAM type: NRG; PAM sequence: GGG
agaaaatgaataggtaagct

SEQ ID NO: 9798 - DNA, 20 bp, Artificial Sequence
  Description of Artificial Sequence: Synthetic oligonucleotide
  Target: AGXT; (-) strand; PAM type: NRG; PAM sequence: TGG
aagaaaatgaataggtaagc

SEQ ID NO: 9799 - DNA, 20 bp, Artificial Sequence
  Description of Artificial Sequence: Synthetic oligonucleotide
  Target: AGXT; (-) strand; PAM type: NRG; PAM sequence: AAG
aattaagaaaatgaataggt

SEQ ID NO: 9800 - DNA, 20 bp, Artificial Sequence
  Description of Artificial Sequence: Synthetic oligonucleotide
  Target: AGXT; (-) strand; PAM type: NRG; PAM sequence: AGG
acacaattaagaaaatgaat

SEQ ID NO: 9801 - DNA, 20 bp, Artificial Sequence
  Description of Artificial Sequence: Synthetic oligonucleotide
  Target: AGXT; (-) strand; PAM type: NRG; PAM sequence: TAG
gacacaattaagaaaatgaa

SEQ ID NO: 9802 - DNA, 20 bp, Artificial Sequence
  Description of Artificial Sequence: Synthetic oligonucleotide
  Target: AGXT; (-) strand; PAM type: NRG; PAM sequence: AAG
gctctttgaaagacacaatt

SEQ ID NO: 9803 - DNA, 20 bp, Artificial Sequence
  Description of Artificial Sequence: Synthetic oligonucleotide
  Target: AGXT; (-) strand; PAM type: NRG; PAM sequence: AAG
tgaaaatacctgctctttga

SEQ ID NO: 9804 - DNA, 20 bp, Artificial Sequence
  Description of Artificial Sequence: Synthetic oligonucleotide
  Target: AGXT; (-) strand; PAM type: NRG; PAM sequence: TAG
gatacaaacagcccagacca

SEQ ID NO: 9805 - DNA, 20 bp, Artificial Sequence
  Description of Artificial Sequence: Synthetic oligonucleotide
  Target: AGXT; (-) strand; PAM type: NRG; PAM sequence: CAG
tagacaagatacaaacagcc

SEQ ID NO: 9806 - DNA, 20 bp, Artificial Sequence
  Description of Artificial Sequence: Synthetic oligonucleotide
  Target: AGXT; (-) strand; PAM type: NRG; PAM sequence: CAG
tttcttagacaagatacaaa

SEQ ID NO: 9807 - DNA, 20 bp, Artificial Sequence
  Description of Artificial Sequence: Synthetic oligonucleotide
  Target: AGXT; (-) strand; PAM type: NRG; PAM sequence: AAG
taggcaaaggtttcttagac

SEQ ID NO: 9808 - DNA, 20 bp, Artificial Sequence
  Description of Artificial Sequence: Synthetic oligonucleotide
  Target: AGXT; (-) strand; PAM type: NRG; PAM sequence: TAG
caaagtaggcaaaggtttct

SEQ ID NO: 9809 - DNA, 20 bp, Artificial Sequence
  Description of Artificial Sequence: Synthetic oligonucleotide
  Target: AGXT; (-) strand; PAM type: NRG; PAM sequence: AGG
ccagacctcaaagtaggcaa

SEQ ID NO: 9810 - DNA, 20 bp, Artificial Sequence
  Description of Artificial Sequence: Synthetic oligonucleotide
  Target: AGXT; (-) strand; PAM type: NRG; PAM sequence: AAG
tccagacctcaaagtaggca

SEQ ID NO: 9811 - DNA, 20 bp, Artificial Sequence
  Description of Artificial Sequence: Synthetic oligonucleotide
  Target: AGXT; (-) strand; PAM type: NRG; PAM sequence: AGG
taccgtccagacctcaaagt

SEQ ID NO: 9812 - DNA, 20 bp, Artificial Sequence
  Description of Artificial Sequence: Synthetic oligonucleotide
  Target: AGXT; (-) strand; PAM type: NRG; PAM sequence: TAG
ataccgtccagacctcaaag

SEQ ID NO: 9813 - DNA, 20 bp, Artificial Sequence
  Description of Artificial Sequence: Synthetic oligonucleotide
  Target: AGXT; (-) strand; PAM type: NRG; PAM sequence: AAG
aagataccgtccagacctca

SEQ ID NO: 9814 - DNA, 20 bp, Artificial Sequence
  Description of Artificial Sequence: Synthetic oligonucleotide
  Target: AGXT; (-) strand; PAM type: NRG; PAM sequence: CAG
aaacacaggaagataccgtc

SEQ ID NO: 9815 - DNA, 20 bp, Artificial Sequence
  Description of Artificial Sequence: Synthetic oligonucleotide
  Target: AGXT; (-) strand; PAM type: NRG; PAM sequence: AAG
tttctagaagaaaacacagg

SEQ ID NO: 9816 - DNA, 20 bp, Artificial Sequence
  Description of Artificial Sequence: Synthetic oligonucleotide
  Target: AGXT; (-) strand; PAM type: NRG; PAM sequence: AGG
aagtttctagaagaaaacac

SEQ ID NO: 9817 - DNA, 20 bp, Artificial Sequence
  Description of Artificial Sequence: Synthetic oligonucleotide
  Target: AGXT; (-) strand; PAM type: NRG; PAM sequence: CAG
aaagtttctagaagaaaaca

SEQ ID NO: 9818 - DNA, 20 bp, Artificial Sequence
  Description of Artificial Sequence: Synthetic oligonucleotide
  Target: AGXT; (-) strand; PAM type: NRG; PAM sequence: AAG
tgacactgtaaagtttctag

SEQ ID NO: 9819 - DNA, 20 bp, Artificial Sequence
  Description of Artificial Sequence: Synthetic oligonucleotide
  Target: AGXT; (-) strand; PAM type: NRG; PAM sequence: TAG
agctgacactgtaaagtttc

SEQ ID NO: 9820 - DNA, 20 bp, Artificial Sequence
  Description of Artificial Sequence: Synthetic oligonucleotide
  Target: AGXT; (-) strand; PAM type: NRG; PAM sequence: AAG
atacaaaagctgacactgta

SEQ ID NO: 9821 - DNA, 20 bp, Artificial Sequence
  Description of Artificial Sequence: Synthetic oligonucleotide
  Target: AGXT; (-) strand; PAM type: NRG; PAM sequence: AAG
tatcatagacctaaatacaa

SEQ ID NO: 9822 - DNA, 20 bp, Artificial Sequence
  Description of Artificial Sequence: Synthetic oligonucleotide
  Target: AGXT; (-) strand; PAM type: NRG; PAM sequence: TAG
aattaatatgaggtgtatca

SEQ ID NO: 9823 - DNA, 20 bp, Artificial Sequence
  Description of Artificial Sequence: Synthetic oligonucleotide
  Target: AGXT; (-) strand; PAM type: NRG; PAM sequence: AGG
ctgtgcacaaaattaatatg

SEQ ID NO: 9824 - DNA, 20 bp, Artificial Sequence
  Description of Artificial Sequence: Synthetic oligonucleotide
  Target: AGXT; (-) strand; PAM type: NRG; PAM sequence: GAG
actgtgcacaaaattaatat

SEQ ID NO: 9825 - DNA, 20 bp, Artificial Sequence
  Description of Artificial Sequence: Synthetic oligonucleotide
  Target: AGXT; (-) strand; PAM type: NRG; PAM sequence: TGG
ctggaactgggatatcagta

SEQ ID NO: 9826 - DNA, 20 bp, Artificial Sequence
  Description of Artificial Sequence: Synthetic oligonucleotide
  Target: AGXT; (-) strand; PAM type: NRG; PAM sequence: CAG
cgttactggaactgggatat

SEQ ID NO: 9827 - DNA, 20 bp, Artificial Sequence
  Description of Artificial Sequence: Synthetic oligonucleotide
  Target: AGXT; (-) strand; PAM type: NRG; PAM sequence: GGG
taacaaacgttactggaact

SEQ ID NO: 9828 - DNA, 20 bp, Artificial Sequence
  Description of Artificial Sequence: Synthetic oligonucleotide
  Target: AGXT; (-) strand; PAM type: NRG; PAM sequence: TGG
ttaacaaacgttactggaac

SEQ ID NO: 9829 - DNA, 20 bp, Artificial Sequence
  Description of Artificial Sequence: Synthetic oligonucleotide
  Target: AGXT; (-) strand; PAM type: NRG; PAM sequence: TGG
gtctgtttaacaaacgttac

SEQ ID NO: 9830 - DNA, 20 bp, Artificial Sequence
  Description of Artificial Sequence: Synthetic oligonucleotide
  Target: AGXT; (-) strand; PAM type: NRG; PAM sequence: AAG
tcagttcaatggggaaagga

SEQ ID NO: 9831 - DNA, 20 bp, Artificial Sequence
  Description of Artificial Sequence: Synthetic oligonucleotide
  Target: AGXT; (-) strand; PAM type: NRG; PAM sequence: AGG
caagtcagttcaatggggaa

SEQ ID NO: 9832 - DNA, 20 bp, Artificial Sequence
  Description of Artificial Sequence: Synthetic oligonucleotide
  Target: AGXT; (-) strand; PAM type: NRG; PAM sequence: AAG
tcaagtcagttcaatgggga

SEQ ID NO: 9833 - DNA, 20 bp, Artificial Sequence
  Description of Artificial Sequence: Synthetic oligonucleotide
  Target: AGXT; (-) strand; PAM type: NRG; PAM sequence: GGG
gttgtcaagtcagttcaatg

SEQ ID NO: 9834 - DNA, 20 bp, Artificial Sequence
  Description of Artificial Sequence: Synthetic oligonucleotide
  Target: AGXT; (-) strand; PAM type: NRG; PAM sequence: GGG
agttgtcaagtcagttcaat

SEQ ID NO: 9835 - DNA, 20 bp, Artificial Sequence
  Description of Artificial Sequence: Synthetic oligonucleotide
  Target: AGXT; (-) strand; PAM type: NRG; PAM sequence: TGG
aagttgtcaagtcagttcaa

SEQ ID NO: 9836 - DNA, 20 bp, Artificial Sequence
  Description of Artificial Sequence: Synthetic oligonucleotide
  Target: AGXT; (-) strand; PAM type: NRG; PAM sequence: CAG
ttttaacaaagttgtcaagt

SEQ ID NO: 9837 - DNA, 20 bp, Artificial Sequence
  Description of Artificial Sequence: Synthetic oligonucleotide
  Target: AGXT; (-) strand; PAM type: NRG; PAM sequence: AAG
tgatttttaacaaagttgtc

SEQ ID NO: 9838 - DNA, 20 bp, Artificial Sequence
  Description of Artificial Sequence: Synthetic oligonucleotide
  Target: AGXT; (-) strand; PAM type: NRG; PAM sequence: AAG
tagtcaactgatttttaaca

SEQ ID NO: 9839 - DNA, 20 bp, Artificial Sequence
  Description of Artificial Sequence: Synthetic oligonucleotide
  Target: AGXT; (-) strand; PAM type: NRG; PAM sequence: TAG
taaatagacctatgaatgtg

SEQ ID NO: 9840 - DNA, 20 bp, Artificial Sequence
  Description of Artificial Sequence: Synthetic oligonucleotide
  Target: AGXT; (-) strand; PAM type: NRG; PAM sequence: TAG
aacagaagagaggctgtaaa

SEQ ID NO: 9841 - DNA, 20 bp, Artificial Sequence
  Description of Artificial Sequence: Synthetic oligonucleotide
  Target: AGXT; (-) strand; PAM type: NRG; PAM sequence: AGG
gatgcaatgaaacagaagag

SEQ ID NO: 9842 - DNA, 20 bp, Artificial Sequence
  Description of Artificial Sequence: Synthetic oligonucleotide
  Target: AGXT; (-) strand; PAM type: NRG; PAM sequence: GAG
ggatgcaatgaaacagaaga

SEQ ID NO: 9843 - DNA, 20 bp, Artificial Sequence
  Description of Artificial Sequence: Synthetic oligonucleotide
  Target: AGXT; (-) strand; PAM type: NRG; PAM sequence: GAG
gaggatgcaatgaaacagaa

SEQ ID NO: 9844 - DNA, 20 bp, Artificial Sequence
  Description of Artificial Sequence: Synthetic oligonucleotide
  Target: AGXT; (-) strand; PAM type: NRG; PAM sequence: AAG
acgaggatgcaatgaaacag

SEQ ID NO: 9845 - DNA, 20 bp, Artificial Sequence
  Description of Artificial Sequence: Synthetic oligonucleotide
  Target: AGXT; (-) strand; PAM type: NRG; PAM sequence: CAG
gacacgaggatgcaatgaaa

SEQ ID NO: 9846 - DNA, 20 bp, Artificial Sequence
  Description of Artificial Sequence: Synthetic oligonucleotide
  Target: AGXT; (-) strand; PAM type: NRG; PAM sequence: AGG
aacagcatgggattgacacg

SEQ ID NO: 9847 - DNA, 20 bp, Artificial Sequence
  Description of Artificial Sequence: Synthetic oligonucleotide
  Target: AGXT; (-) strand; PAM type: NRG; PAM sequence: GAG
caacagcatgggattgacac

SEQ ID NO: 9848 - DNA, 20 bp, Artificial Sequence
  Description of Artificial Sequence: Synthetic oligonucleotide
  Target: AGXT; (-) strand; PAM type: NRG; PAM sequence: GGG
tacaatatttgcaacagcat

SEQ ID NO: 9849 - DNA, 20 bp, Artificial Sequence
  Description of Artificial Sequence: Synthetic oligonucleotide
  Target: AGXT; (-) strand; PAM type: NRG; PAM sequence: TGG
ctacaatatttgcaacagca

SEQ ID NO: 9850 - DNA, 20 bp, Artificial Sequence
  Description of Artificial Sequence: Synthetic oligonucleotide
  Target: AGXT; (-) strand; PAM type: NRG; PAM sequence: CAG
taaagctacaatatttgcaa

SEQ ID NO: 9851 - DNA, 20 bp, Artificial Sequence
  Description of Artificial Sequence: Synthetic oligonucleotide
  Target: AGXT; (-) strand; PAM type: NRG; PAM sequence: AAG
taatttcaagagttattgta

SEQ ID NO: 9852 - DNA, 20 bp, Artificial Sequence
  Description of Artificial Sequence: Synthetic oligonucleotide
  Target: AGXT; (-) strand; PAM type: NRG; PAM sequence: GAG
ggacttgttcttaatttcaa

SEQ ID NO: 9853 - DNA, 20 bp, Artificial Sequence
  Description of Artificial Sequence: Synthetic oligonucleotide
  Target: AGXT; (-) strand; PAM type: NRG; PAM sequence: AAG
gaggacttgttcttaatttc

SEQ ID NO: 9854 - DNA, 20 bp, Artificial Sequence
  Description of Artificial Sequence: Synthetic oligonucleotide
  Target: AGXT; (-) strand; PAM type: NRG; PAM sequence: AGG
aaaagggagaaaaacattgg

SEQ ID NO: 9855 - DNA, 20 bp, Artificial Sequence
  Description of Artificial Sequence: Synthetic oligonucleotide
  Target: AGXT; (-) strand; PAM type: NRG; PAM sequence: GAG
taaaagggagaaaaacattg

SEQ ID NO: 9856 - DNA, 20 bp, Artificial Sequence
  Description of Artificial Sequence: Synthetic oligonucleotide
  Target: AGXT; (-) strand; PAM type: NRG; PAM sequence: TGG
tttaaaagggagaaaaacat

SEQ ID NO: 9857 - DNA, 20 bp, Artificial Sequence
  Description of Artificial Sequence: Synthetic oligonucleotide
  Target: AGXT; (-) strand; PAM type: NRG; PAM sequence: GAG
tacaaaaaacctttaaaagg

SEQ ID NO: 9858 - DNA, 20 bp, Artificial Sequence
  Description of Artificial Sequence: Synthetic oligonucleotide
  Target: AGXT; (-) strand; PAM type: NRG; PAM sequence: GGG
aatacaaaaaacctttaaaa

SEQ ID NO: 9859 - DNA, 20 bp, Artificial Sequence
  Description of Artificial Sequence: Synthetic oligonucleotide
  Target: AGXT; (-) strand; PAM type: NRG; PAM sequence: AGG
gaatacaaaaaacctttaaa

SEQ ID NO: 9860 - DNA, 20 bp, Artificial Sequence
  Description of Artificial Sequence: Synthetic oligonucleotide
  Target: AGXT; (-) strand; PAM type: NRG; PAM sequence: AAG
agaatacaaaaaacctttaa

SEQ ID NO: 9861 - DNA, 20 bp, Artificial Sequence
  Description of Artificial Sequence: Synthetic oligonucleotide
  Target: AGXT; (-) strand; PAM type: NRG; PAM sequence: TAG
acacagaaattcaaaggatg

SEQ ID NO: 9862 - DNA, 20 bp, Artificial Sequence
  Description of Artificial Sequence: Synthetic oligonucleotide
  Target: AGXT; (-) strand; PAM type: NRG; PAM sequence: AGG
aaacgtacacagaaattcaa

SEQ ID NO: 9863 - DNA, 20 bp, Artificial Sequence
  Description of Artificial Sequence: Synthetic oligonucleotide
  Target: AGXT; (-) strand; PAM type: NRG; PAM sequence: AAG
aaaacgtacacagaaattca

SEQ ID NO: 9864 - DNA, 20 bp, Artificial Sequence
  Description of Artificial Sequence: Synthetic oligonucleotide
  Target: AGXT; (-) strand; PAM type: NRG; PAM sequence: CAG
acatgaatctaaaacgtaca

SEQ ID NO: 9865 - DNA, 20 bp, Artificial Sequence
  Description of Artificial Sequence: Synthetic oligonucleotide
  Target: AGXT; (-) strand; PAM type: NRG; PAM sequence: TAG
agcaagctattctgaagaaa

SEQ ID NO: 9866 - DNA, 20 bp, Artificial Sequence
  Description of Artificial Sequence: Synthetic oligonucleotide
  Target: AGXT; (-) strand; PAM type: NRG; PAM sequence: AAG
aatttcagcaagctattctg

SEQ ID NO: 9867 - DNA, 20 bp, Artificial Sequence
  Description of Artificial Sequence: Synthetic oligonucleotide
  Target: AGXT; (-) strand; PAM type: NRG; PAM sequence: AAG
gttcctaccaaaatttcagc

SEQ ID NO: 9868 - DNA, 20 bp, Artificial Sequence
  Description of Artificial Sequence: Synthetic oligonucleotide
  Target: AGXT; (-) strand; PAM type: NRG; PAM sequence: CAG
tgcagttcctaccaaaattt

SEQ ID NO: 9869 - DNA, 20 bp, Artificial Sequence
  Description of Artificial Sequence: Synthetic oligonucleotide
  Target: AGXT; (-) strand; PAM type: NRG; PAM sequence: CAG
cttgatatatagatttggtg

SEQ ID NO: 9870 - DNA, 20 bp, Artificial Sequence
  Description of Artificial Sequence: Synthetic oligonucleotide
  Target: AGXT; (-) strand; PAM type: NRG; PAM sequence: TGG
cttaacttgatatatagatt

SEQ ID NO: 9871 - DNA, 20 bp, Artificial Sequence
  Description of Artificial Sequence: Synthetic oligonucleotide
  Target: AGXT; (-) strand; PAM type: NRG; PAM sequence: TAG
attttccttaacttgatata

SEQ ID NO: 9872 - DNA, 20 bp, Artificial Sequence
  Description of Artificial Sequence: Synthetic oligonucleotide
  Target: AGXT; (-) strand; PAM type: NRG; PAM sequence: TGG
ttacatttctgtttgtgaaa

SEQ ID NO: 9873 - DNA, 20 bp, Artificial Sequence
  Description of Artificial Sequence: Synthetic oligonucleotide
  Target: AGXT; (-) strand; PAM type: NRG; PAM sequence: AAG
aaaactagaaacattgctga

SEQ ID NO: 9874 - DNA, 20 bp, Artificial Sequence
  Description of Artificial Sequence: Synthetic oligonucleotide
  Target: AGXT; (-) strand; PAM type: NRG; PAM sequence: TAG
ctttgctgtatgttgaaaac

SEQ ID NO: 9875 - DNA, 20 bp, Artificial Sequence
  Description of Artificial Sequence: Synthetic oligonucleotide
  Target: AGXT; (-) strand; PAM type: NRG; PAM sequence: TGG
ctttcctgttcctgggttcc

SEQ ID NO: 9876 - DNA, 20 bp, Artificial Sequence
  Description of Artificial Sequence: Synthetic oligonucleotide
  Target: AGXT; (-) strand; PAM type: NRG; PAM sequence: GGG
tcagtggctttcctgttcct

SEQ ID NO: 9877 - DNA, 20 bp, Artificial Sequence
  Description of Artificial Sequence: Synthetic oligonucleotide
  Target: AGXT; (-) strand; PAM type: NRG; PAM sequence: TGG
atcagtggctttcctgttcc

SEQ ID NO: 9878 - DNA, 20 bp, Artificial Sequence
  Description of Artificial Sequence: Synthetic oligonucleotide
  Target: AGXT; (-) strand; PAM type: NRG; PAM sequence: TGG
tgcctcctgggctggatcag

SEQ ID NO: 9879 - DNA, 20 bp, Artificial Sequence
  Description of Artificial Sequence: Synthetic oligonucleotide
  Target: AGXT; (-) strand; PAM type: NRG; PAM sequence: CAG
tcctgcctcctgggctggat

SEQ ID NO: 9880 - DNA, 20 bp, Artificial Sequence
  Description of Artificial Sequence: Synthetic oligonucleotide
  Target: AGXT; (-) strand; PAM type: NRG; PAM sequence: TGG
cctggtcctgcctcctgggc

SEQ ID NO: 9881 - DNA, 20 bp, Artificial Sequence
  Description of Artificial Sequence: Synthetic oligonucleotide
  Target: AGXT; (-) strand; PAM type: NRG; PAM sequence: GGG
gctgcctggtcctgcctcct

SEQ ID NO: 9882 - DNA, 20 bp, Artificial Sequence
  Description of Artificial Sequence: Synthetic oligonucleotide
  Target: AGXT; (-) strand; PAM type: NRG; PAM sequence: TGG
ggctgcctggtcctgcctcc

SEQ ID NO: 9883 - DNA, 20 bp, Artificial Sequence
  Description of Artificial Sequence: Synthetic oligonucleotide
  Target: AGXT; (-) strand; PAM type: NRG; PAM sequence: TGG
tgggggccggggaggctgcc

SEQ ID NO: 9884 - DNA, 20 bp, Artificial Sequence
  Description of Artificial Sequence: Synthetic oligonucleotide
  Target: AGXT; (-) strand; PAM type: NRG; PAM sequence: AGG
agggccgctgggggccgggg

SEQ ID NO: 9885 - DNA, 20 bp, Artificial Sequence
  Description of Artificial Sequence: Synthetic oligonucleotide
  Target: AGXT; (-) strand; PAM type: NRG; PAM sequence: GAG
aagggccgctgggggccggg

SEQ ID NO: 9886 - DNA, 20 bp, Artificial Sequence
  Description of Artificial Sequence: Synthetic oligonucleotide
  Target: AGXT; (-) strand; PAM type: NRG; PAM sequence: GGG
agaagggccgctgggggccg

SEQ ID NO: 9887 - DNA, 20 bp, Artificial Sequence
  Description of Artificial Sequence: Synthetic oligonucleotide
  Target: AGXT; (-) strand; PAM type: NRG; PAM sequence: GGG
gagaagggccgctgggggcc

SEQ ID NO: 9888 - DNA, 20 bp, Artificial Sequence
  Description of Artificial Sequence: Synthetic oligonucleotide
  Target: AGXT; (-) strand; PAM type: NRG; PAM sequence: CGG
ggagaagggccgctgggggc

SEQ ID NO: 9889 - DNA, 20 bp, Artificial Sequence
  Description of Artificial Sequence: Synthetic oligonucleotide
  Target: AGXT; (-) strand; PAM type: NRG; PAM sequence: GGG
ggagggagaagggccgctgg

SEQ ID NO: 9890 - DNA, 20 bp, Artificial Sequence
  Description of Artificial Sequence: Synthetic oligonucleotide
  Target: AGXT; (-) strand; PAM type: NRG; PAM sequence: GGG
tggagggagaagggccgctg

SEQ ID NO: 9891 - DNA, 20 bp, Artificial Sequence
  Description of Artificial Sequence: Synthetic oligonucleotide
  Target: AGXT; (-) strand; PAM type: NRG; PAM sequence: GGG
ttggagggagaagggccgct

SEQ ID NO: 9892 - DNA, 20 bp, Artificial Sequence
  Description of Artificial Sequence: Synthetic oligonucleotide
  Target: AGXT; (-) strand; PAM type: NRG; PAM sequence: TGG
cttggagggagaagggccgc

SEQ ID NO: 9893 - DNA, 20 bp, Artificial Sequence
  Description of Artificial Sequence: Synthetic oligonucleotide
  Target: AGXT; (-) strand; PAM type: NRG; PAM sequence: GGG
ggttctacttggagggagaa

SEQ ID NO: 9894 - DNA, 20 bp, Artificial Sequence
  Description of Artificial Sequence: Synthetic oligonucleotide
  Target: AGXT; (-) strand; PAM type: NRG; PAM sequence: AGG
aggttctacttggagggaga

SEQ ID NO: 9895 - DNA, 20 bp, Artificial Sequence
  Description of Artificial Sequence: Synthetic oligonucleotide
  Target: AGXT; (-) strand; PAM type: NRG; PAM sequence: AAG
gaggttctacttggagggag

SEQ ID NO: 9896 - DNA, 20 bp, Artificial Sequence
  Description of Artificial Sequence: Synthetic oligonucleotide
  Target: AGXT; (-) strand; PAM type: NRG; PAM sequence: GAG
caggaggttctacttggagg

SEQ ID NO: 9897 - DNA, 20 bp, Artificial Sequence
  Description of Artificial Sequence: Synthetic oligonucleotide
  Target: AGXT; (-) strand; PAM type: NRG; PAM sequence: GGG
tccaggaggttctacttgga

SEQ ID NO: 9898 - DNA, 20 bp, Artificial Sequence
  Description of Artificial Sequence: Synthetic oligonucleotide
  Target: AGXT; (-) strand; PAM type: NRG; PAM sequence: AGG
ttccaggaggttctacttgg

SEQ ID NO: 9899 - DNA, 20 bp, Artificial Sequence
  Description of Artificial Sequence: Synthetic oligonucleotide
  Target: AGXT; (-) strand; PAM type: NRG; PAM sequence: GAG
tttccaggaggttctacttg

SEQ ID NO: 9900 - DNA, 20 bp, Artificial Sequence
  Description of Artificial Sequence: Synthetic oligonucleotide
  Target: AGXT; (-) strand; PAM type: NRG; PAM sequence: TGG
tgtttccaggaggttctact

SEQ ID NO: 9901 - DNA, 20 bp, Artificial Sequence
  Description of Artificial Sequence: Synthetic oligonucleotide
  Target: AGXT; (-) strand; PAM type: NRG; PAM sequence: AGG
ccaagtgggctgtttccagg

SEQ ID NO: 9902 - DNA, 20 bp, Artificial Sequence
  Description of Artificial Sequence: Synthetic oligonucleotide
  Target: AGXT; (-) strand; PAM type: NRG; PAM sequence: GAG
cccaagtgggctgtttccag

SEQ ID NO: 9903 - DNA, 20 bp, Artificial Sequence
  Description of Artificial Sequence: Synthetic oligonucleotide
  Target: AGXT; (-) strand; PAM type: NRG; PAM sequence: AGG
cgcccaagtgggctgtttcc

SEQ ID NO: 9904 - DNA, 20 bp, Artificial Sequence
  Description of Artificial Sequence: Synthetic oligonucleotide
  Target: AGXT; (-) strand; PAM type: NRG; PAM sequence: CAG
acgcccaagtgggctgtttc

SEQ ID NO: 9905 - DNA, 20 bp, Artificial Sequence
  Description of Artificial Sequence: Synthetic oligonucleotide
  Target: AGXT; (-) strand; PAM type: NRG; PAM sequence: GGG
caaaagatctacgcccaagt

SEQ ID NO: 9906 - DNA, 20 bp, Artificial Sequence
  Description of Artificial Sequence: Synthetic oligonucleotide
  Target: AGXT; (-) strand; PAM type: NRG; PAM sequence: TGG
acaaaagatctacgcccaag

SEQ ID NO: 9907 - DNA, 20 bp, Artificial Sequence
  Description of Artificial Sequence: Synthetic oligonucleotide
  Target: AGXT; (-) strand; PAM type: NRG; PAM sequence: AAG
ctaacaaaagatctacgccc

SEQ ID NO: 9908 - DNA, 20 bp, Artificial Sequence
  Description of Artificial Sequence: Synthetic oligonucleotide
  Target: AGXT; (-) strand; PAM type: NRG; PAM sequence: AAG
cctaggaataaatctaacaa

SEQ ID NO: 9909 - DNA, 20 bp, Artificial Sequence
  Description of Artificial Sequence: Synthetic oligonucleotide
  Target: AGXT; (-) strand; PAM type: NRG; PAM sequence: AGG
atcaacaagatcaaacacct

SEQ ID NO: 9910 - DNA, 20 bp, Artificial Sequence
  Description of Artificial Sequence: Synthetic oligonucleotide
  Target: AGXT; (-) strand; PAM type: NRG; PAM sequence: TAG
catcaacaagatcaaacacc

SEQ ID NO: 9911 - DNA, 20 bp, Artificial Sequence
  Description of Artificial Sequence: Synthetic oligonucleotide
  Target: AGXT; (-) strand; PAM type: NRG; PAM sequence: AAG
ccatttataacagcatcaac

SEQ ID NO: 9912 - DNA, 20 bp, Artificial Sequence
  Description of Artificial Sequence: Synthetic oligonucleotide
  Target: AGXT; (-) strand; PAM type: NRG; PAM sequence: CAG
ttttcaaatgccatttataa

SEQ ID NO: 9913 - DNA, 20 bp, Artificial Sequence
  Description of Artificial Sequence: Synthetic oligonucleotide
  Target: AGXT; (-) strand; PAM type: NRG; PAM sequence: TGG
tatattaaaaaataaacaac

SEQ ID NO: 9914 - DNA, 20 bp, Artificial Sequence
  Description of Artificial Sequence: Synthetic oligonucleotide
  Target: AGXT; (-) strand; PAM type: NRG; PAM sequence: GAG
aaattaatatagaaaaaaat

SEQ ID NO: 9915 - DNA, 20 bp, Artificial Sequence
  Description of Artificial Sequence: Synthetic oligonucleotide
  Target: AGXT; (-) strand; PAM type: NRG; PAM sequence: TAG
cagaagatacaaaattaata

SEQ ID NO: 9916 - DNA, 20 bp, Artificial Sequence
  Description of Artificial Sequence: Synthetic oligonucleotide
  Target: AGXT; (-) strand; PAM type: NRG; PAM sequence: AAG
tgtgaatttaggaaggtcag

SEQ ID NO: 9917 - DNA, 20 bp, Artificial Sequence
  Description of Artificial Sequence: Synthetic oligonucleotide
  Target: AGXT; (-) strand; PAM type: NRG; PAM sequence: CAG
ccttgtgaatttaggaaggt

SEQ ID NO: 9918 - DNA, 20 bp, Artificial Sequence
  Description of Artificial Sequence: Synthetic oligonucleotide
  Target: AGXT; (-) strand; PAM type: NRG; PAM sequence: AGG
taggccttgtgaatttagga

SEQ ID NO: 9919 - DNA, 20 bp, Artificial Sequence
  Description of Artificial Sequence: Synthetic oligonucleotide
  Target: AGXT; (-) strand; PAM type: NRG; PAM sequence: AAG
ctaggccttgtgaatttagg

SEQ ID NO: 9920 - DNA, 20 bp, Artificial Sequence
  Description of Artificial Sequence: Synthetic oligonucleotide
  Target: AGXT; (-) strand; PAM type: NRG; PAM sequence: AGG
ctactaggccttgtgaattt

SEQ ID NO: 9921 - DNA, 20 bp, Artificial Sequence
  Description of Artificial Sequence: Synthetic oligonucleotide
  Target: AGXT; (-) strand; PAM type: NRG; PAM sequence: TAG
gctactaggccttgtgaatt

SEQ ID NO: 9922 - DNA, 20 bp, Artificial Sequence
  Description of Artificial Sequence: Synthetic oligonucleotide
  Target: AGXT; (-) strand; PAM type: NRG; PAM sequence: AGG
gaatctacaaagaagctact

SEQ ID NO: 9923 - DNA, 20 bp, Artificial Sequence
  Description of Artificial Sequence: Synthetic oligonucleotide
  Target: AGXT; (-) strand; PAM type: NRG; PAM sequence: TAG
ggaatctacaaagaagctac

SEQ ID NO: 9924 - DNA, 20 bp, Artificial Sequence
  Description of Artificial Sequence: Synthetic oligonucleotide
  Target: AGXT; (-) strand; PAM type: NRG; PAM sequence: AAG
atttaaaggaatctacaaag

SEQ ID NO: 9925 - DNA, 20 bp, Artificial Sequence
  Description of Artificial Sequence: Synthetic oligonucleotide
  Target: AGXT; (-) strand; PAM type: NRG; PAM sequence: AAG
aaaatttaaaggaatctaca

SEQ ID NO: 9926 - DNA, 20 bp, Artificial Sequence
  Description of Artificial Sequence: Synthetic oligonucleotide
  Target: AGXT; (-) strand; PAM type: NRG; PAM sequence: AGG
tatctacttagaaaatttaa

SEQ ID NO: 9927 - DNA, 20 bp, Artificial Sequence
  Description of Artificial Sequence: Synthetic oligonucleotide
  Target: AGXT; (-) strand; PAM type: NRG; PAM sequence: AAG
ttatctacttagaaaattta

SEQ ID NO: 9928 - DNA, 20 bp, Artificial Sequence
  Description of Artificial Sequence: Synthetic oligonucleotide
  Target: AGXT; (-) strand; PAM type: NRG; PAM sequence: TAG
agagagtttgattatctact

SEQ ID NO: 9929 - DNA, 20 bp, Artificial Sequence
  Description of Artificial Sequence: Synthetic oligonucleotide
  Target: AGXT; (-) strand; PAM type: NRG; PAM sequence: GAG
caactctcattagtcacaga

SEQ ID NO: 9930 - DNA, 20 bp, Artificial Sequence
  Description of Artificial Sequence: Synthetic oligonucleotide
  Target: AGXT; (-) strand; PAM type: NRG; PAM sequence: GAG
tacaactctcattagtcaca

SEQ ID NO: 9931 - DNA, 20 bp, Artificial Sequence
  Description of Artificial Sequence: Synthetic oligonucleotide
  Target: AGXT; (-) strand; PAM type: NRG; PAM sequence: CAG
tgtacaactctcattagtca

SEQ ID NO: 9932 - DNA, 20 bp, Artificial Sequence
  Description of Artificial Sequence: Synthetic oligonucleotide
  Target: AGXT; (-) strand; PAM type: NRG; PAM sequence: TAG
agaagatgtacaactctcat

SEQ ID NO: 9933 - DNA, 20 bp, Artificial Sequence
  Description of Artificial Sequence: Synthetic oligonucleotide
  Target: AGXT; (-) strand; PAM type: NRG; PAM sequence: AAG
aaaaagtacataaaaggcag

SEQ ID NO: 9934 - DNA, 20 bp, Artificial Sequence
  Description of Artificial Sequence: Synthetic oligonucleotide
  Target: AGXT; (-) strand; PAM type: NRG; PAM sequence: CAG
aagaaaaagtacataaaagg

SEQ ID NO: 9935 - DNA, 20 bp, Artificial Sequence
  Description of Artificial Sequence: Synthetic oligonucleotide
  Target: AGXT; (-) strand; PAM type: NRG; PAM sequence: AGG
agcaagaaaaagtacataaa

SEQ ID NO: 9936 - DNA, 20 bp, Artificial Sequence
  Description of Artificial Sequence: Synthetic oligonucleotide
  Target: AGXT; (-) strand; PAM type: NRG; PAM sequence: AAG
aagcaagaaaaagtacataa

SEQ ID NO: 9937 - DNA, 20 bp, Artificial Sequence
  Description of Artificial Sequence: Synthetic oligonucleotide
  Target: AGXT; (-) strand; PAM type: NRG; PAM sequence: AAG
cgttgcaatgaagcaagaaa

SEQ ID NO: 9938 - DNA, 20 bp, Artificial Sequence
  Description of Artificial Sequence: Synthetic oligonucleotide
  Target: AGXT; (-) strand; PAM type: NRG; PAM sequence: AAG
ctacaccgttgcaatgaagc

SEQ ID NO: 9939 - DNA, 20 bp, Artificial Sequence
  Description of Artificial Sequence: Synthetic oligonucleotide
  Target: AGXT; (-) strand; PAM type: NRG; PAM sequence: AAG
tggcctacaccgttgcaatg

SEQ ID NO: 9940 - DNA, 20 bp, Artificial Sequence
  Description of Artificial Sequence: Synthetic oligonucleotide
  Target: AGXT; (-) strand; PAM type: NRG; PAM sequence: TGG
gagattcagcactgtatttg

SEQ ID NO: 9941 - DNA, 20 bp, Artificial Sequence
  Description of Artificial Sequence: Synthetic oligonucleotide
  Target: AGXT; (-) strand; PAM type: NRG; PAM sequence: CAG
gcacactcatcactgagatt

SEQ ID NO: 9942 - DNA, 20 bp, Artificial Sequence
  Description of Artificial Sequence: Synthetic oligonucleotide
  Target: AGXT; (-) strand; PAM type: NRG; PAM sequence: GAG
gaaggtgcacactcatcact

SEQ ID NO: 9943 - DNA, 20 bp, Artificial Sequence
  Description of Artificial Sequence: Synthetic oligonucleotide
  Target: AGXT; (-) strand; PAM type: NRG; PAM sequence: AGG
aacacgtctccaaggcgaga

SEQ ID NO: 9944 - DNA, 20 bp, Artificial Sequence
  Description of Artificial Sequence: Synthetic oligonucleotide
  Target: AGXT; (-) strand; PAM type: NRG; PAM sequence: AAG
aaacacgtctccaaggcgag

SEQ ID NO: 9945 - DNA, 20 bp, Artificial Sequence
  Description of Artificial Sequence: Synthetic oligonucleotide
  Target: AGXT; (-) strand; PAM type: NRG; PAM sequence: GAG
attaaacacgtctccaaggc

SEQ ID NO: 9946 - DNA, 20 bp, Artificial Sequence
  Description of Artificial Sequence: Synthetic oligonucleotide
  Target: AGXT; (-) strand; PAM type: NRG; PAM sequence: AGG
agacattaaacacgtctcca

SEQ ID NO: 9947 - DNA, 20 bp, Artificial Sequence
  Description of Artificial Sequence: Synthetic oligonucleotide
  Target: AGXT; (-) strand; PAM type: NRG; PAM sequence: AAG
gagacattaaacacgtctcc

SEQ ID NO: 9948 - DNA, 20 bp, Artificial Sequence
  Description of Artificial Sequence: Synthetic oligonucleotide
  Target: AGXT; (-) strand; PAM type: NRG; PAM sequence: GAG
gctgccgtcagcctgacgct

SEQ ID NO: 9949 - DNA, 20 bp, Artificial Sequence
  Description of Artificial Sequence: Synthetic oligonucleotide
  Target: AGXT; (-) strand; PAM type: NRG; PAM sequence: CAG
agaaaccccactgctgccgt

SEQ ID NO: 9950 - DNA, 20 bp, Artificial Sequence
  Description of Artificial Sequence: Synthetic oligonucleotide
  Target: AGXT; (-) strand; PAM type: NRG; PAM sequence: CAG
ctgtgagagcagggcagctg

SEQ ID NO: 9951 - DNA, 20 bp, Artificial Sequence
  Description of Artificial Sequence: Synthetic oligonucleotide
  Target: AGXT; (-) strand; PAM type: NRG; PAM sequence: CAG
tcctgcctgtgagagcaggg

SEQ ID NO: 9952 - DNA, 20 bp, Artificial Sequence
  Description of Artificial Sequence: Synthetic oligonucleotide
  Target: AGXT; (-) strand; PAM type: NRG; PAM sequence: GGG
acttcctgcctgtgagagca

SEQ ID NO: 9953 - DNA, 20 bp, Artificial Sequence
  Description of Artificial Sequence: Synthetic oligonucleotide
  Target: AGXT; (-) strand; PAM type: NRG; PAM sequence: AGG
gacttcctgcctgtgagagc

SEQ ID NO: 9954 - DNA, 20 bp, Artificial Sequence
  Description of Artificial Sequence: Synthetic oligonucleotide
  Target: AGXT; (-) strand; PAM type: NRG; PAM sequence: CAG
ggacttcctgcctgtgagag

SEQ ID NO: 9955 - DNA, 20 bp, Artificial Sequence
  Description of Artificial Sequence: Synthetic oligonucleotide
  Target: AGXT; (-) strand; PAM type: NRG; PAM sequence: GAG
tggggacttcctgcctgtga

SEQ ID NO: 9956 - DNA, 20 bp, Artificial Sequence
  Description of Artificial Sequence: Synthetic oligonucleotide
  Target: AGXT; (-) strand; PAM type: NRG; PAM sequence: GAG
ggtggggacttcctgcctgt

SEQ ID NO: 9957 - DNA, 20 bp, Artificial Sequence
  Description of Artificial Sequence: Synthetic oligonucleotide
  Target: AGXT; (-) strand; PAM type: NRG; PAM sequence: GGG
tctgcaaactaggacaggtg

SEQ ID NO: 9958 - DNA, 20 bp, Artificial Sequence
  Description of Artificial Sequence: Synthetic oligonucleotide
  Target: AGXT; (-) strand; PAM type: NRG; PAM sequence: GGG
ctctgcaaactaggacaggt

SEQ ID NO: 9959 - DNA, 20 bp, Artificial Sequence
  Description of Artificial Sequence: Synthetic oligonucleotide
  Target: AGXT; (-) strand; PAM type: NRG; PAM sequence: TGG
cctctgcaaactaggacagg

SEQ ID NO: 9960 - DNA, 20 bp, Artificial Sequence
  Description of Artificial Sequence: Synthetic oligonucleotide
  Target: AGXT; (-) strand; PAM type: NRG; PAM sequence: AGG
taccctctgcaaactaggac

SEQ ID NO: 9961 - DNA, 20 bp, Artificial Sequence
  Description of Artificial Sequence: Synthetic oligonucleotide
  Target: AGXT; (-) strand; PAM type: NRG; PAM sequence: CAG
ataccctctgcaaactagga

SEQ ID NO: 9962 - DNA, 20 bp, Artificial Sequence
  Description of Artificial Sequence: Synthetic oligonucleotide
  Target: AGXT; (-) strand; PAM type: NRG; PAM sequence: AGG
ataaataccctctgcaaact

SEQ ID NO: 9963 - DNA, 20 bp, Artificial Sequence
  Description of Artificial Sequence: Synthetic oligonucleotide
  Target: AGXT; (-) strand; PAM type: NRG; PAM sequence: TAG
gataaataccctctgcaaac

SEQ ID NO: 9964 - DNA, 20 bp, Artificial Sequence
  Description of Artificial Sequence: Synthetic oligonucleotide
  Target: AGXT; (-) strand; PAM type: NRG; PAM sequence: TAG
tgacaaaatacaacagctgt

SEQ ID NO: 9965 - DNA, 20 bp, Artificial Sequence
  Description of Artificial Sequence: Synthetic oligonucleotide
  Target: AGXT; (-) strand; PAM type: NRG; PAM sequence: CAG
aggtatttgacaaaatacaa

SEQ ID NO: 9966 - DNA, 20 bp, Artificial Sequence
  Description of Artificial Sequence: Synthetic oligonucleotide
  Target: AGXT; (-) strand; PAM type: NRG; PAM sequence: AGG
catctcaccataggcagaaa

SEQ ID NO: 9967 - DNA, 20 bp, Artificial Sequence
  Description of Artificial Sequence: Synthetic oligonucleotide
  Target: AGXT; (-) strand; PAM type: NRG; PAM sequence: AAG
tcatctcaccataggcagaa

SEQ ID NO: 9968 - DNA, 20 bp, Artificial Sequence
  Description of Artificial Sequence: Synthetic oligonucleotide
  Target: AGXT; (-) strand; PAM type: NRG; PAM sequence: CAG
tatgatcatctcaccatagg

SEQ ID NO: 9969 - DNA, 20 bp, Artificial Sequence
  Description of Artificial Sequence: Synthetic oligonucleotide
  Target: AGXT; (-) strand; PAM type: NRG; PAM sequence: AGG
ctttatgatcatctcaccat

SEQ ID NO: 9970 - DNA, 20 bp, Artificial Sequence
  Description of Artificial Sequence: Synthetic oligonucleotide
  Target: AGXT; (-) strand; PAM type: NRG; PAM sequence: TAG
actttatgatcatctcacca

SEQ ID NO: 9971 - DNA, 20 bp, Artificial Sequence
  Description of Artificial Sequence: Synthetic oligonucleotide
  Target: AGXT; (-) strand; PAM type: NRG; PAM sequence: TAG
aacagcacatccgtagaata

SEQ ID NO: 9972 - DNA, 20 bp, Artificial Sequence
  Description of Artificial Sequence: Synthetic oligonucleotide
  Target: AGXT; (-) strand; PAM type: NRG; PAM sequence: TAG
tcaacaaaacagcacatccg

SEQ ID NO: 9973 - DNA, 20 bp, Artificial Sequence
  Description of Artificial Sequence: Synthetic oligonucleotide
  Target: AGXT; (-) strand; PAM type: NRG; PAM sequence: CAG
taagaggtcagtcaacaaaa

SEQ ID NO: 9974 - DNA, 20 bp, Artificial Sequence
  Description of Artificial Sequence: Synthetic oligonucleotide
  Target: AGXT; (-) strand; PAM type: NRG; PAM sequence: CAG
attacgagaaaataagaggt

SEQ ID NO: 9975 - DNA, 20 bp, Artificial Sequence
  Description of Artificial Sequence: Synthetic oligonucleotide
  Target: AGXT; (-) strand; PAM type: NRG; PAM sequence: AGG
atatattacgagaaaataag

SEQ ID NO: 9976 - DNA, 20 bp, Artificial Sequence
  Description of Artificial Sequence: Synthetic oligonucleotide
  Target: AGXT; (-) strand; PAM type: NRG; PAM sequence: GAG
aatatattacgagaaaataa

SEQ ID NO: 9977 - DNA, 20 bp, Artificial Sequence
  Description of Artificial Sequence: Synthetic oligonucleotide
  Target: AGXT; (-) strand; PAM type: NRG; PAM sequence: AAG
caaatatattacgagaaaat

SEQ ID NO: 9978 - DNA, 20 bp, Artificial Sequence
  Description of Artificial Sequence: Synthetic oligonucleotide
  Target: AGXT; (-) strand; PAM type: NRG; PAM sequence: GAG
aaacctgacaaatatattac

SEQ ID NO: 9979 - DNA, 20 bp, Artificial Sequence
  Description of Artificial Sequence: Synthetic oligonucleotide
  Target: AGXT; (-) strand; PAM type: NRG; PAM sequence: AAG
tactgtccaaaccactttac

SEQ ID NO: 9980 - DNA, 20 bp, Artificial Sequence
  Description of Artificial Sequence: Synthetic oligonucleotide
  Target: AGXT; (-) strand; PAM type: NRG; PAM sequence: AAG
ttaattgataaataaaggaa

SEQ ID NO: 9981 - DNA, 20 bp, Artificial Sequence
  Description of Artificial Sequence: Synthetic oligonucleotide
  Target: AGXT; (-) strand; PAM type: NRG; PAM sequence: AGG
caaatttaattgataaataa

SEQ ID NO: 9982 - DNA, 20 bp, Artificial Sequence
  Description of Artificial Sequence: Synthetic oligonucleotide
  Target: AGXT; (-) strand; PAM type: NRG; PAM sequence: AAG
acaaatttaattgataaata

SEQ ID NO: 9983 - DNA, 20 bp, Artificial Sequence
  Description of Artificial Sequence: Synthetic oligonucleotide
  Target: AGXT; (-) strand; PAM type: NRG; PAM sequence: TAG
aaaaaaaatagtccctattc

SEQ ID NO: 9984 - DNA, 20 bp, Artificial Sequence
  Description of Artificial Sequence: Synthetic oligonucleotide
  Target: AGXT; (-) strand; PAM type: NRG; PAM sequence: TAG
aaatataaggaaaaaaaaaa

SEQ ID NO: 9985 - DNA, 20 bp, Artificial Sequence
  Description of Artificial Sequence: Synthetic oligonucleotide
  Target: AGXT; (-) strand; PAM type: NRG; PAM sequence: AGG
gacaattctaccaaaatata

SEQ ID NO: 9986 - DNA, 20 bp, Artificial Sequence
  Description of Artificial Sequence: Synthetic oligonucleotide
  Target: AGXT; (-) strand; PAM type: NRG; PAM sequence: AAG
ggacaattctaccaaaatat

SEQ ID NO: 9987 - DNA, 20 bp, Artificial Sequence
  Description of Artificial Sequence: Synthetic oligonucleotide
  Target: AGXT; (-) strand; PAM type: NRG; PAM sequence: TGG
cctgtcccataaagcttcac

SEQ ID NO: 9988 - DNA, 20 bp, Artificial Sequence
  Description of Artificial Sequence: Synthetic oligonucleotide
  Target: AGXT; (-) strand; PAM type: NRG; PAM sequence: AAG
aagaaagctcctgtcccata

SEQ ID NO: 9989 - DNA, 20 bp, Artificial Sequence
  Description of Artificial Sequence: Synthetic oligonucleotide
  Target: AGXT; (-) strand; PAM type: NRG; PAM sequence: AAG
aaaaatccttcccataaaga

SEQ ID NO: 9990 - DNA, 20 bp, Artificial Sequence
  Description of Artificial Sequence: Synthetic oligonucleotide
  Target: AGXT; (-) strand; PAM type: NRG; PAM sequence: AAG
ttaaaaaaatccttcccata

SEQ ID NO: 9991 - DNA, 20 bp, Artificial Sequence
  Description of Artificial Sequence: Synthetic oligonucleotide
  Target: AGXT; (-) strand; PAM type: NRG; PAM sequence: AAG
tatgtctatgaaaacattag

SEQ ID NO: 9992 - DNA, 20 bp, Artificial Sequence
  Description of Artificial Sequence: Synthetic oligonucleotide
  Target: AGXT; (-) strand; PAM type: NRG; PAM sequence: TAG
ctctatgtctatgaaaacat

SEQ ID NO: 9993 - DNA, 20 bp, Artificial Sequence
  Description of Artificial Sequence: Synthetic oligonucleotide
  Target: AGXT; (-) strand; PAM type: NRG; PAM sequence: AAG
aagagagagacaaaaatcta

SEQ ID NO: 9994 - DNA, 20 bp, Artificial Sequence
  Description of Artificial Sequence: Synthetic oligonucleotide
  Target: AGXT; (-) strand; PAM type: NRG; PAM sequence: GAG
ccaaaacgggcacaaagaga

SEQ ID NO: 9995 - DNA, 20 bp, Artificial Sequence
  Description of Artificial Sequence: Synthetic oligonucleotide
  Target: AGXT; (-) strand; PAM type: NRG; PAM sequence: GAG
taccaaaacgggcacaaaga

SEQ ID NO: 9996 - DNA, 20 bp, Artificial Sequence
  Description of Artificial Sequence: Synthetic oligonucleotide
  Target: AGXT; (-) strand; PAM type: NRG; PAM sequence: GAG
attaccaaaacgggcacaaa

SEQ ID NO: 9997 - DNA, 20 bp, Artificial Sequence
  Description of Artificial Sequence: Synthetic oligonucleotide
  Target: AGXT; (-) strand; PAM type: NRG; PAM sequence: AAG
aaattaccaaaacgggcaca

SEQ ID NO: 9998 - DNA, 20 bp, Artificial Sequence
  Description of Artificial Sequence: Synthetic oligonucleotide
  Target: AGXT; (-) strand; PAM type: NRG; PAM sequence: GGG
gtaacacaaattaccaaaac

SEQ ID NO: 9999 - DNA, 20 bp, Artificial Sequence
  Description of Artificial Sequence: Synthetic oligonucleotide
  Target: AGXT; (-) strand; PAM type: NRG; PAM sequence: CGG
ggtaacacaaattaccaaaa

SEQ ID NO: 10000 - DNA, 20 bp, Artificial Sequence
  Description of Artificial Sequence: Synthetic oligonucleotide
  Target: AGXT; (-) strand; PAM type: NRG; PAM sequence: GGG
cttggaatcaagcatgctct

SEQ ID NO: 10001 - DNA, 20 bp, Artificial Sequence
  Description of Artificial Sequence: Synthetic oligonucleotide
  Target: AGXT; (-) strand; PAM type: NRG; PAM sequence: TGG
acttggaatcaagcatgctc

SEQ ID NO: 10002 - DNA, 20 bp, Artificial Sequence
  Description of Artificial Sequence: Synthetic oligonucleotide
  Target: AGXT; (-) strand; PAM type: NRG; PAM sequence: AAG
acattcaacaacttggaatc

SEQ ID NO: 10003 - DNA, 20 bp, Artificial Sequence
  Description of Artificial Sequence: Synthetic oligonucleotide
  Target: AGXT; (-) strand; PAM type: NRG; PAM sequence: TGG
tgccaacacattcaacaact

SEQ ID NO: 10004 - DNA, 20 bp, Artificial Sequence
  Description of Artificial Sequence: Synthetic oligonucleotide
  Target: AGXT; (-) strand; PAM type: NRG; PAM sequence: TGG
aggataataaagggatatta

SEQ ID NO: 10005 - DNA, 20 bp, Artificial Sequence
  Description of Artificial Sequence: Synthetic oligonucleotide
  Target: AGXT; (-) strand; PAM type: NRG; PAM sequence: GGG
aagcattaaaggataataaa

SEQ ID NO: 10006 - DNA, 20 bp, Artificial Sequence
  Description of Artificial Sequence: Synthetic oligonucleotide
  Target: AGXT; (-) strand; PAM type: NRG; PAM sequence: AGG
taagcattaaaggataataa

SEQ ID NO: 10007 - DNA, 20 bp, Artificial Sequence
  Description of Artificial Sequence: Synthetic oligonucleotide
  Target: AGXT; (-) strand; PAM type: NRG; PAM sequence: AAG
gtaagcattaaaggataata

SEQ ID NO: 10008 - DNA, 20 bp, Artificial Sequence
  Description of Artificial Sequence: Synthetic oligonucleotide
  Target: AGXT; (-) strand; PAM type: NRG; PAM sequence: AGG
agagagcccgtaagcattaa

SEQ ID NO: 10009 - DNA, 20 bp, Artificial Sequence
  Description of Artificial Sequence: Synthetic oligonucleotide
  Target: AGXT; (-) strand; PAM type: NRG; PAM sequence: AAG
tagagagcccgtaagcatta

SEQ ID NO: 10010 - DNA, 20 bp, Artificial Sequence
  Description of Artificial Sequence: Synthetic oligonucleotide
  Target: AGXT; (-) strand; PAM type: NRG; PAM sequence: AAG
gaaatcaatagagagcccgt

SEQ ID NO: 10011 - DNA, 20 bp, Artificial Sequence
  Description of Artificial Sequence: Synthetic oligonucleotide
  Target: AGXT; (-) strand; PAM type: NRG; PAM sequence: GAG
gaaacagggaaatcaataga

SEQ ID NO: 10012 - DNA, 20 bp, Artificial Sequence
  Description of Artificial Sequence: Synthetic oligonucleotide
  Target: AGXT; (-) strand; PAM type: NRG; PAM sequence: GAG
atgaaacagggaaatcaata

SEQ ID NO: 10013 - DNA, 20 bp, Artificial Sequence
  Description of Artificial Sequence: Synthetic oligonucleotide
  Target: AGXT; (-) strand; PAM type: NRG; PAM sequence: TAG
gaatgaaacagggaaatcaa

SEQ ID NO: 10014 - DNA, 20 bp, Artificial Sequence
  Description of Artificial Sequence: Synthetic oligonucleotide
  Target: AGXT; (-) strand; PAM type: NRG; PAM sequence: GGG
ccaataccaggaatgaaaca

SEQ ID NO: 10015 - DNA, 20 bp, Artificial Sequence
  Description of Artificial Sequence: Synthetic oligonucleotide
  Target: AGXT; (-) strand; PAM type: NRG; PAM sequence: AGG
accaataccaggaatgaaac

SEQ ID NO: 10016 - DNA, 20 bp, Artificial Sequence
  Description of Artificial Sequence: Synthetic oligonucleotide
  Target: AGXT; (-) strand; PAM type: NRG; PAM sequence: CAG
taccaataccaggaatgaaa

SEQ ID NO: 10017 - DNA, 20 bp, Artificial Sequence
  Description of Artificial Sequence: Synthetic oligonucleotide
  Target: AGXT; (-) strand; PAM type: NRG; PAM sequence: AGG
aaatataaattaccaatacc

SEQ ID NO: 10018 - DNA, 20 bp, Artificial Sequence
  Description of Artificial Sequence: Synthetic oligonucleotide
  Target: AGXT; (-) strand; PAM type: NRG; PAM sequence: CAG
aaaatataaattaccaatac

SEQ ID NO: 10019 - DNA, 20 bp, Artificial Sequence
  Description of Artificial Sequence: Synthetic oligonucleotide
  Target: AGXT; (-) strand; PAM type: NRG; PAM sequence: GAG
atcaatgggagaaaaaaaag

SEQ ID NO: 10020 - DNA, 20 bp, Artificial Sequence
  Description of Artificial Sequence: Synthetic oligonucleotide
  Target: AGXT; (-) strand; PAM type: NRG; PAM sequence: AGG
tgatcaatgggagaaaaaaa

SEQ ID NO: 10021 - DNA, 20 bp, Artificial Sequence
  Description of Artificial Sequence: Synthetic oligonucleotide
  Target: AGXT; (-) strand; PAM type: NRG; PAM sequence: AAG
ctgatcaatgggagaaaaaa

SEQ ID NO: 10022 - DNA, 20 bp, Artificial Sequence
  Description of Artificial Sequence: Synthetic oligonucleotide
  Target: AGXT; (-) strand; PAM type: NRG; PAM sequence: GAG
ctagcaagactgatcaatgg

SEQ ID NO: 10023 - DNA, 20 bp, Artificial Sequence
  Description of Artificial Sequence: Synthetic oligonucleotide
  Target: AGXT; (-) strand; PAM type: NRG; PAM sequence: GGG
ccctagcaagactgatcaat

SEQ ID NO: 10024 - DNA, 20 bp, Artificial Sequence
  Description of Artificial Sequence: Synthetic oligonucleotide
  Target: AGXT; (-) strand; PAM type: NRG; PAM sequence: TGG
cccctagcaagactgatcaa

SEQ ID NO: 10025 - DNA, 20 bp, Artificial Sequence
  Description of Artificial Sequence: Synthetic oligonucleotide
  Target: AGXT; (-) strand; PAM type: NRG; PAM sequence: AAG
aaaatcagtaaccccctagc

SEQ ID NO: 10026 - DNA, 20 bp, Artificial Sequence
  Description of Artificial Sequence: Synthetic oligonucleotide
  Target: AGXT; (-) strand; PAM type: NRG; PAM sequence: TAG
taataaaatcagtaaccccc

SEQ ID NO: 10027 - DNA, 20 bp, Artificial Sequence
  Description of Artificial Sequence: Synthetic oligonucleotide
  Target: AGXT; (-) strand; PAM type: NRG; PAM sequence: CAG
tttggagagactaataaaat

SEQ ID NO: 10028 - DNA, 20 bp, Artificial Sequence
  Description of Artificial Sequence: Synthetic oligonucleotide
  Target: AGXT; (-) strand; PAM type: NRG; PAM sequence: GAG
gtaaatgtcgcttttttgga

SEQ ID NO: 10029 - DNA, 20 bp, Artificial Sequence
  Description of Artificial Sequence: Synthetic oligonucleotide
  Target: AGXT; (-) strand; PAM type: NRG; PAM sequence: GAG
tggtaaatgtcgcttttttg

SEQ ID NO: 10030 - DNA, 20 bp, Artificial Sequence
  Description of Artificial Sequence: Synthetic oligonucleotide
  Target: AGXT; (-) strand; PAM type: NRG; PAM sequence: TGG
gatggtaaatgtcgcttttt

SEQ ID NO: 10031 - DNA, 20 bp, Artificial Sequence
  Description of Artificial Sequence: Synthetic oligonucleotide
  Target: AGXT; (-) strand; PAM type: NRG; PAM sequence: TGG
gcaaacaattgagaaaatga

SEQ ID NO: 10032 - DNA, 20 bp, Artificial Sequence
  Description of Artificial Sequence: Synthetic oligonucleotide
  Target: AGXT; (-) strand; PAM type: NRG; PAM sequence: GAG
tcaatacaaagcaaacaatt

SEQ ID NO: 10033 - DNA, 20 bp, Artificial Sequence
  Description of Artificial Sequence: Synthetic oligonucleotide
  Target: AGXT; (-) strand; PAM type: NRG; PAM sequence: AAG
taagagtggaaatcaataca

SEQ ID NO: 10034 - DNA, 20 bp, Artificial Sequence
  Description of Artificial Sequence: Synthetic oligonucleotide
  Target: AGXT; (-) strand; PAM type: NRG; PAM sequence: TGG
aataaaaggaacaataagag

SEQ ID NO: 10035 - DNA, 20 bp, Artificial Sequence
  Description of Artificial Sequence: Synthetic oligonucleotide
  Target: AGXT; (-) strand; PAM type: NRG; PAM sequence: GAG
taaaataaaaggaacaataa

SEQ ID NO: 10036 - DNA, 20 bp, Artificial Sequence
  Description of Artificial Sequence: Synthetic oligonucleotide
  Target: AGXT; (-) strand; PAM type: NRG; PAM sequence: AAG
agtaaaataaaaggaacaat

SEQ ID NO: 10037 - DNA, 20 bp, Artificial Sequence
  Description of Artificial Sequence: Synthetic oligonucleotide
  Target: AGXT; (-) strand; PAM type: NRG; PAM sequence: AGG
accaaaggaagtaaaataaa

SEQ ID NO: 10038 - DNA, 20 bp, Artificial Sequence
  Description of Artificial Sequence: Synthetic oligonucleotide
  Target: AGXT; (-) strand; PAM type: NRG; PAM sequence: AAG
aaccaaaggaagtaaaataa

SEQ ID NO: 10039 - DNA, 20 bp, Artificial Sequence
  Description of Artificial Sequence: Synthetic oligonucleotide
  Target: AGXT; (-) strand; PAM type: NRG; PAM sequence: AAG
gagcaaattaaaaccaaagg

SEQ ID NO: 10040 - DNA, 20 bp, Artificial Sequence
  Description of Artificial Sequence: Synthetic oligonucleotide
  Target: AGXT; (-) strand; PAM type: NRG; PAM sequence: AGG
gaggagcaaattaaaaccaa

SEQ ID NO: 10041 - DNA, 20 bp, Artificial Sequence
  Description of Artificial Sequence: Synthetic oligonucleotide
  Target: AGXT; (-) strand; PAM type: NRG; PAM sequence: AAG
agaggagcaaattaaaacca

SEQ ID NO: 10042 - DNA, 20 bp, Artificial Sequence
  Description of Artificial Sequence: Synthetic oligonucleotide
  Target: AGXT; (-) strand; PAM type: NRG; PAM sequence: GAG
ataggaagctagaaaaagag

SEQ ID NO: 10043 - DNA, 20 bp, Artificial Sequence
  Description of Artificial Sequence: Synthetic oligonucleotide
  Target: AGXT; (-) strand; PAM type: NRG; PAM sequence: AGG
ccataggaagctagaaaaag

SEQ ID NO: 10044 - DNA, 20 bp, Artificial Sequence
  Description of Artificial Sequence: Synthetic oligonucleotide
  Target: AGXT; (-) strand; PAM type: NRG; PAM sequence: GAG
accataggaagctagaaaaa

SEQ ID NO: 10045 - DNA, 20 bp, Artificial Sequence
  Description of Artificial Sequence: Synthetic oligonucleotide
  Target: AGXT; (-) strand; PAM type: NRG; PAM sequence: AAG
ctaccataggaagctagaaa

SEQ ID NO: 10046 - DNA, 20 bp, Artificial Sequence
  Description of Artificial Sequence: Synthetic oligonucleotide
  Target: AGXT; (-) strand; PAM type: NRG; PAM sequence: TAG
aagcttctaccataggaagc

SEQ ID NO: 10047 - DNA, 20 bp, Artificial Sequence
  Description of Artificial Sequence: Synthetic oligonucleotide
  Target: AGXT; (-) strand; PAM type: NRG; PAM sequence: AAG
aattaagcttctaccatagg

SEQ ID NO: 10048 - DNA, 20 bp, Artificial Sequence
  Description of Artificial Sequence: Synthetic oligonucleotide
  Target: AGXT; (-) strand; PAM type: NRG; PAM sequence: AGG
atcaattaagcttctaccat

SEQ ID NO: 10049 - DNA, 20 bp, Artificial Sequence
  Description of Artificial Sequence: Synthetic oligonucleotide
  Target: AGXT; (-) strand; PAM type: NRG; PAM sequence: TAG
aatcaattaagcttctacca

SEQ ID NO: 10050 - DNA, 20 bp, Artificial Sequence
  Description of Artificial Sequence: Synthetic oligonucleotide
  Target: AGXT; (-) strand; PAM type: NRG; PAM sequence: AAG
ataaatgtttaaaatcaatt

SEQ ID NO: 10051 - DNA, 20 bp, Artificial Sequence
  Description of Artificial Sequence: Synthetic oligonucleotide
  Target: AGXT; (-) strand; PAM type: NRG; PAM sequence: TAG
ttagctttaaatgctcatac

SEQ ID NO: 10052 - DNA, 20 bp, Artificial Sequence
  Description of Artificial Sequence: Synthetic oligonucleotide
  Target: AGXT; (-) strand; PAM type: NRG; PAM sequence: TAG
ggcgctcagagggaaatgtt

SEQ ID NO: 10053 - DNA, 20 bp, Artificial Sequence
  Description of Artificial Sequence: Synthetic oligonucleotide
  Target: AGXT; (-) strand; PAM type: NRG; PAM sequence: GGG
cagtgaagaaggcgctcaga

SEQ ID NO: 10054 - DNA, 20 bp, Artificial Sequence
  Description of Artificial Sequence: Synthetic oligonucleotide
  Target: AGXT; (-) strand; PAM type: NRG; PAM sequence: AGG
gcagtgaagaaggcgctcag

SEQ ID NO: 10055 - DNA, 20 bp, Artificial Sequence
  Description of Artificial Sequence: Synthetic oligonucleotide
  Target: AGXT; (-) strand; PAM type: NRG; PAM sequence: GAG
tgcagtgaagaaggcgctca

SEQ ID NO: 10056 - DNA, 20 bp, Artificial Sequence
  Description of Artificial Sequence: Synthetic oligonucleotide
  Target: AGXT; (-) strand; PAM type: NRG; PAM sequence: CAG
gatgcagtgaagaaggcgct

SEQ ID NO: 10057 - DNA, 20 bp, Artificial Sequence
  Description of Artificial Sequence: Synthetic oligonucleotide
  Target: AGXT; (-) strand; PAM type: NRG; PAM sequence: AGG
tttgggagatgcagtgaaga

SEQ ID NO: 10058 - DNA, 20 bp, Artificial Sequence
  Description of Artificial Sequence: Synthetic oligonucleotide
  Target: AGXT; (-) strand; PAM type: NRG; PAM sequence: AAG
atttgggagatgcagtgaag

SEQ ID NO: 10059 - DNA, 20 bp, Artificial Sequence
  Description of Artificial Sequence: Synthetic oligonucleotide
  Target: AGXT; (-) strand; PAM type: NRG; PAM sequence: AAG
aaaatttgggagatgcagtg

SEQ ID NO: 10060 - DNA, 20 bp, Artificial Sequence
  Description of Artificial Sequence: Synthetic oligonucleotide
  Target: AGXT; (-) strand; PAM type: NRG; PAM sequence: CAG
tgattaaaatttgggagatg

SEQ ID NO: 10061 - DNA, 20 bp, Artificial Sequence
  Description of Artificial Sequence: Synthetic oligonucleotide
  Target: AGXT; (-) strand; PAM type: NRG; PAM sequence: GAG
caccattgattaaaatttgg

SEQ ID NO: 10062 - DNA, 20 bp, Artificial Sequence
  Description of Artificial Sequence: Synthetic oligonucleotide
  Target: AGXT; (-) strand; PAM type: NRG; PAM sequence: GGG
aacaccattgattaaaattt

SEQ ID NO: 10063 - DNA, 20 bp, Artificial Sequence
  Description of Artificial Sequence: Synthetic oligonucleotide
  Target: AGXT; (-) strand; PAM type: NRG; PAM sequence: TGG
aaacaccattgattaaaatt

SEQ ID NO: 10064 - DNA, 20 bp, Artificial Sequence
  Description of Artificial Sequence: Synthetic oligonucleotide
  Target: AGXT; (-) strand; PAM type: NRG; PAM sequence: GAG
attataaaatattttgatct

SEQ ID NO: 10065 - DNA, 20 bp, Artificial Sequence
  Description of Artificial Sequence: Synthetic oligonucleotide
  Target: AGXT; (-) strand; PAM type: NRG; PAM sequence: AGG
ggttcaaagaataaatcaca

SEQ ID NO: 10066 - DNA, 20 bp, Artificial Sequence
  Description of Artificial Sequence: Synthetic oligonucleotide
  Target: AGXT; (-) strand; PAM type: NRG; PAM sequence: AAG
tggttcaaagaataaatcac

SEQ ID NO: 10067 - DNA, 20 bp, Artificial Sequence
  Description of Artificial Sequence: Synthetic oligonucleotide
  Target: AGXT; (-) strand; PAM type: NRG; PAM sequence: AAG
tctaaatagtctgtggttca

SEQ ID NO: 10068 - DNA, 20 bp, Artificial Sequence
  Description of Artificial Sequence: Synthetic oligonucleotide
  Target: AGXT; (-) strand; PAM type: NRG; PAM sequence: TGG
gtataagtctaaatagtctg

SEQ ID NO: 10069 - DNA, 20 bp, Artificial Sequence
  Description of Artificial Sequence: Synthetic oligonucleotide
  Target: AGXT; (-) strand; PAM type: NRG; PAM sequence: TAG
ttacacagtataagtctaaa

SEQ ID NO: 10070 - DNA, 20 bp, Artificial Sequence
  Description of Artificial Sequence: Synthetic oligonucleotide
  Target: AGXT; (-) strand; PAM type: NRG; PAM sequence: AAG
atctgaacattacacagtat

SEQ ID NO: 10071 - DNA, 20 bp, Artificial Sequence
  Description of Artificial Sequence: Synthetic oligonucleotide
  Target: AGXT; (-) strand; PAM type: NRG; PAM sequence: CAG
ccaaatatctgaacattaca

SEQ ID NO: 10072 - DNA, 20 bp, Artificial Sequence
  Description of Artificial Sequence: Synthetic oligonucleotide
  Target: AGXT; (-) strand; PAM type: NRG; PAM sequence: TAG
ataaaaaacaaaaatacatt

SEQ ID NO: 10073 - DNA, 20 bp, Artificial Sequence
  Description of Artificial Sequence: Synthetic oligonucleotide
  Target: AGXT; (-) strand; PAM type: NRG; PAM sequence: CAG
agtatgagctctgaccacaa

SEQ ID NO: 10074 - DNA, 20 bp, Artificial Sequence
  Description of Artificial Sequence: Synthetic oligonucleotide
  Target: AGXT; (-) strand; PAM type: NRG; PAM sequence: GAG
ctgaagtccatatacagtat

SEQ ID NO: 10075 - DNA, 20 bp, Artificial Sequence
  Description of Artificial Sequence: Synthetic oligonucleotide
  Target: AGXT; (-) strand; PAM type: NRG; PAM sequence: CAG
aaaatactgaagtccatata

SEQ ID NO: 10076 - DNA, 20 bp, Artificial Sequence
  Description of Artificial Sequence: Synthetic oligonucleotide
  Target: AGXT; (-) strand; PAM type: NRG; PAM sequence: AAG
agtacatgttcaaaatactg

SEQ ID NO: 10077 - DNA, 20 bp, Artificial Sequence
  Description of Artificial Sequence: Synthetic oligonucleotide
  Target: AGXT; (-) strand; PAM type: NRG; PAM sequence: CAG
tagtttataaaacagactct

SEQ ID NO: 10078 - DNA, 20 bp, Artificial Sequence
  Description of Artificial Sequence: Synthetic oligonucleotide
  Target: AGXT; (-) strand; PAM type: NRG; PAM sequence: CAG
actgctgctagtttataaaa

SEQ ID NO: 10079 - DNA, 20 bp, Artificial Sequence
  Description of Artificial Sequence: Synthetic oligonucleotide
  Target: AGXT; (-) strand; PAM type: NRG; PAM sequence: TAG
atagtcaccgagactgctgc

SEQ ID NO: 10080 - DNA, 20 bp, Artificial Sequence
  Description of Artificial Sequence: Synthetic oligonucleotide
  Target: AGXT; (-) strand; PAM type: NRG; PAM sequence: GAG
gtgtccatgggatagtcacc

SEQ ID NO: 10081 - DNA, 20 bp, Artificial Sequence
  Description of Artificial Sequence: Synthetic oligonucleotide
  Target: AGXT; (-) strand; PAM type: NRG; PAM sequence: TAG
ttcatctcgtgtccatggga

SEQ ID NO: 10082 - DNA, 20 bp, Artificial Sequence
  Description of Artificial Sequence: Synthetic oligonucleotide
  Target: AGXT; (-) strand; PAM type: NRG; PAM sequence: GGG
cacgttcatctcgtgtccat

SEQ ID NO: 10083 - DNA, 20 bp, Artificial Sequence
  Description of Artificial Sequence: Synthetic oligonucleotide
  Target: AGXT; (-) strand; PAM type: NRG; PAM sequence: TGG
acacgttcatctcgtgtcca

SEQ ID NO: 10084 - DNA, 20 bp, Artificial Sequence
  Description of Artificial Sequence: Synthetic oligonucleotide
  Target: AGXT; (-) strand; PAM type: NRG; PAM sequence: AAG
gctcacacctgacaatgacg

SEQ ID NO: 10085 - DNA, 20 bp, Artificial Sequence
  Description of Artificial Sequence: Synthetic oligonucleotide
  Target: AGXT; (-) strand; PAM type: NRG; PAM sequence: AAG
gcggacctgaggatctgtag

SEQ ID NO: 10086 - DNA, 20 bp, Artificial Sequence
  Description of Artificial Sequence: Synthetic oligonucleotide
  Target: AGXT; (-) strand; PAM type: NRG; PAM sequence: TAG
caggcggacctgaggatctg

SEQ ID NO: 10087 - DNA, 20 bp, Artificial Sequence
  Description of Artificial Sequence: Synthetic oligonucleotide
  Target: AGXT; (-) strand; PAM type: NRG; PAM sequence: AGG
ctgtcatccaggcggacctg

SEQ ID NO: 10088 - DNA, 20 bp, Artificial Sequence
  Description of Artificial Sequence: Synthetic oligonucleotide
  Target: AGXT; (-) strand; PAM type: NRG; PAM sequence: GAG
gctgtcatccaggcggacct

SEQ ID NO: 10089 - DNA, 20 bp, Artificial Sequence
  Description of Artificial Sequence: Synthetic oligonucleotide
  Target: AGXT; (-) strand; PAM type: NRG; PAM sequence: CGG
gaacaatgctgtcatccagg

SEQ ID NO: 10090 - DNA, 20 bp, Artificial Sequence
  Description of Artificial Sequence: Synthetic oligonucleotide
  Target: AGXT; (-) strand; PAM type: NRG; PAM sequence: AGG
cttgaacaatgctgtcatcc

SEQ ID NO: 10091 - DNA, 20 bp, Artificial Sequence
  Description of Artificial Sequence: Synthetic oligonucleotide
  Target: AGXT; (-) strand; PAM type: NRG; PAM sequence: CAG
acttgaacaatgctgtcatc

SEQ ID NO: 10092 - DNA, 20 bp, Artificial Sequence
  Description of Artificial Sequence: Synthetic oligonucleotide
  Target: AGXT; (-) strand; PAM type: NRG; PAM sequence: AAG
aaaaccccagtgatacaaag

SEQ ID NO: 10093 - DNA, 20 bp, Artificial Sequence
  Description of Artificial Sequence: Synthetic oligonucleotide
  Target: AGXT; (-) strand; PAM type: NRG; PAM sequence: AAG
aacaaaaccccagtgataca

SEQ ID NO: 10094 - DNA, 20 bp, Artificial Sequence
  Description of Artificial Sequence: Synthetic oligonucleotide
  Target: AGXT; (-) strand; PAM type: NRG; PAM sequence: CAG
aaacaacaacaacaaaaccc

SEQ ID NO: 10095 - DNA, 20 bp, Artificial Sequence
  Description of Artificial Sequence: Synthetic oligonucleotide
  Target: AGXT; (-) strand; PAM type: NRG; PAM sequence: AGG
cagtacttcatagaaaaagc

SEQ ID NO: 10096 - DNA, 20 bp, Artificial Sequence
  Description of Artificial Sequence: Synthetic oligonucleotide
  Target: AGXT; (-) strand; PAM type: NRG; PAM sequence: CAG
tcagtacttcatagaaaaag

SEQ ID NO: 10097 - DNA, 20 bp, Artificial Sequence
  Description of Artificial Sequence: Synthetic oligonucleotide
  Target: AGXT; (-) strand; PAM type: NRG; PAM sequence: AAG
ctctcagtacttcatagaaa

SEQ ID NO: 10098 - DNA, 20 bp, Artificial Sequence
  Description of Artificial Sequence: Synthetic oligonucleotide
  Target: AGXT; (-) strand; PAM type: NRG; PAM sequence: TAG
accccactctcagtacttca

SEQ ID NO: 10099 - DNA, 20 bp, Artificial Sequence
  Description of Artificial Sequence: Synthetic oligonucleotide
  Target: AGXT; (-) strand; PAM type: NRG; PAM sequence: CAG
agaactgaacaccccactct

SEQ ID NO: 10100 - DNA, 20 bp, Artificial Sequence
  Description of Artificial Sequence: Synthetic oligonucleotide
  Target: AGXT; (-) strand; PAM type: NRG; PAM sequence: GAG
caagaccacattcatgctgg

SEQ ID NO: 10101 - DNA, 20 bp, Artificial Sequence
  Description of Artificial Sequence: Synthetic oligonucleotide
  Target: AGXT; (-) strand; PAM type: NRG; PAM sequence: GGG
gacaagaccacattcatgct

SEQ ID NO: 10102 - DNA, 20 bp, Artificial Sequence
  Description of Artificial Sequence: Synthetic oligonucleotide
  Target: AGXT; (-) strand; PAM type: NRG; PAM sequence: TGG
agacaagaccacattcatgc

SEQ ID NO: 10103 - DNA, 20 bp, Artificial Sequence
  Description of Artificial Sequence: Synthetic oligonucleotide
  Target: AGXT; (-) strand; PAM type: NRG; PAM sequence: AAG
gcataaagggagaaggagac

SEQ ID NO: 10104 - DNA, 20 bp, Artificial Sequence
  Description of Artificial Sequence: Synthetic oligonucleotide
  Target: AGXT; (-) strand; PAM type: NRG; PAM sequence: GAG
tgaatgcataaagggagaag

SEQ ID NO: 10105 - DNA, 20 bp, Artificial Sequence
  Description of Artificial Sequence: Synthetic oligonucleotide
  Target: AGXT; (-) strand; PAM type: NRG; PAM sequence: AGG
gatgaatgcataaagggaga

SEQ ID NO: 10106 - DNA, 20 bp, Artificial Sequence
  Description of Artificial Sequence: Synthetic oligonucleotide
  Target: AGXT; (-) strand; PAM type: NRG; PAM sequence: AAG
agatgaatgcataaagggag

SEQ ID NO: 10107 - DNA, 20 bp, Artificial Sequence
  Description of Artificial Sequence: Synthetic oligonucleotide
  Target: AGXT; (-) strand; PAM type: NRG; PAM sequence: GAG
tgaagatgaatgcataaagg

SEQ ID NO: 10108 - DNA, 20 bp, Artificial Sequence
  Description of Artificial Sequence: Synthetic oligonucleotide
  Target: AGXT; (-) strand; PAM type: NRG; PAM sequence: GGG
catgaagatgaatgcataaa

SEQ ID NO: 10109 - DNA, 20 bp, Artificial Sequence
  Description of Artificial Sequence: Synthetic oligonucleotide
  Target: AGXT; (-) strand; PAM type: NRG; PAM sequence: AGG
tcatgaagatgaatgcataa

SEQ ID NO: 10110 - DNA, 20 bp, Artificial Sequence
  Description of Artificial Sequence: Synthetic oligonucleotide
  Target: AGXT; (-) strand; PAM type: NRG; PAM sequence: AAG
atcatgaagatgaatgcata

SEQ ID NO: 10111 - DNA, 20 bp, Artificial Sequence
  Description of Artificial Sequence: Synthetic oligonucleotide
  Target: AGXT; (-) strand; PAM type: NRG; PAM sequence: AAG
aacagaccttcaaaatcatg

SEQ ID NO: 10112 - DNA, 20 bp, Artificial Sequence
  Description of Artificial Sequence: Synthetic oligonucleotide
  Target: AGXT; (-) strand; PAM type: NRG; PAM sequence: CAG
aggtgtaacaatcctaacaa

SEQ ID NO: 10113 - DNA, 20 bp, Artificial Sequence
  Description of Artificial Sequence: Synthetic oligonucleotide
  Target: AGXT; (-) strand; PAM type: NRG; PAM sequence: AGG
aaatagtcagttcatcaaga

SEQ ID NO: 10114 - DNA, 20 bp, Artificial Sequence
  Description of Artificial Sequence: Synthetic oligonucleotide
  Target: AGXT; (-) strand; PAM type: NRG; PAM sequence: AAG
aaaatagtcagttcatcaag

SEQ ID NO: 10115 - DNA, 20 bp, Artificial Sequence
  Description of Artificial Sequence: Synthetic oligonucleotide
  Target: AGXT; (-) strand; PAM type: NRG; PAM sequence: AAG
ataaaaatagtcagttcatc

SEQ ID NO: 10116 - DNA, 20 bp, Artificial Sequence
  Description of Artificial Sequence: Synthetic oligonucleotide
  Target: AGXT; (-) strand; PAM type: NRG; PAM sequence: CAG
ttcacaatgataaaaatagt

SEQ ID NO: 10117 - DNA, 20 bp, Artificial Sequence
  Description of Artificial Sequence: Synthetic oligonucleotide
  Target: AGXT; (-) strand; PAM type: NRG; PAM sequence: TAG
atatttcacaatgataaaaa

SEQ ID NO: 10118 - DNA, 20 bp, Artificial Sequence
  Description of Artificial Sequence: Synthetic oligonucleotide
  Target: AGXT; (-) strand; PAM type: NRG; PAM sequence: GGG
agagtattaccagaggtaag

SEQ ID NO: 10119 - DNA, 20 bp, Artificial Sequence
  Description of Artificial Sequence: Synthetic oligonucleotide
  Target: AGXT; (-) strand; PAM type: NRG; PAM sequence: GGG
aagagtattaccagaggtaa

SEQ ID NO: 10120 - DNA, 20 bp, Artificial Sequence
  Description of Artificial Sequence: Synthetic oligonucleotide
  Target: AGXT; (-) strand; PAM type: NRG; PAM sequence: AGG
aaagagtattaccagaggta

SEQ ID NO: 10121 - DNA, 20 bp, Artificial Sequence
  Description of Artificial Sequence: Synthetic oligonucleotide
  Target: AGXT; (-) strand; PAM type: NRG; PAM sequence: AAG
caaagagtattaccagaggt

SEQ ID NO: 10122 - DNA, 20 bp, Artificial Sequence
  Description of Artificial Sequence: Synthetic oligonucleotide
  Target: AGXT; (-) strand; PAM type: NRG; PAM sequence: AGG
aagacaaagagtattaccag

SEQ ID NO: 10123 - DNA, 20 bp, Artificial Sequence
  Description of Artificial Sequence: Synthetic oligonucleotide
  Target: AGXT; (-) strand; PAM type: NRG; PAM sequence: GAG
taagacaaagagtattacca

SEQ ID NO: 10124 - DNA, 20 bp, Artificial Sequence
  Description of Artificial Sequence: Synthetic oligonucleotide
  Target: AGXT; (-) strand; PAM type: NRG; PAM sequence: CAG
attaagacaaagagtattac

SEQ ID NO: 10125 - DNA, 20 bp, Artificial Sequence
  Description of Artificial Sequence: Synthetic oligonucleotide
  Target: AGXT; (-) strand; PAM type: NRG; PAM sequence: GAG
cacacaaacattaagacaaa

SEQ ID NO: 10126 - DNA, 20 bp, Artificial Sequence
  Description of Artificial Sequence: Synthetic oligonucleotide
  Target: AGXT; (-) strand; PAM type: NRG; PAM sequence: AAG
aacacacaaacattaagaca

SEQ ID NO: 10127 - DNA, 20 bp, Artificial Sequence
  Description of Artificial Sequence: Synthetic oligonucleotide
  Target: AGXT; (-) strand; PAM type: NRG; PAM sequence: AAG
aaagaaaacacacaaacatt

SEQ ID NO: 10128 - DNA, 20 bp, Artificial Sequence
  Description of Artificial Sequence: Synthetic oligonucleotide
  Target: AGXT; (-) strand; PAM type: NRG; PAM sequence: AAG
agagacaagtggcccaagga

SEQ ID NO: 10129 - DNA, 20 bp, Artificial Sequence
  Description of Artificial Sequence: Synthetic oligonucleotide
  Target: AGXT; (-) strand; PAM type: NRG; PAM sequence: AGG
atggagagacaagtggccca

SEQ ID NO: 10130 - DNA, 20 bp, Artificial Sequence
  Description of Artificial Sequence: Synthetic oligonucleotide
  Target: AGXT; (-) strand; PAM type: NRG; PAM sequence: AAG
tatggagagacaagtggccc

SEQ ID NO: 10131 - DNA, 20 bp, Artificial Sequence
  Description of Artificial Sequence: Synthetic oligonucleotide
  Target: AGXT; (-) strand; PAM type: NRG; PAM sequence: TGG
cttttgtatggagagacaag

SEQ ID NO: 10132 - DNA, 20 bp, Artificial Sequence
  Description of Artificial Sequence: Synthetic oligonucleotide
  Target: AGXT; (-) strand; PAM type: NRG; PAM sequence: AAG
tctcttttgtatggagagac

SEQ ID NO: 10133 - DNA, 20 bp, Artificial Sequence
  Description of Artificial Sequence: Synthetic oligonucleotide
  Target: AGXT; (-) strand; PAM type: NRG; PAM sequence: GAG
gttcatctcttttgtatgga

SEQ ID NO: 10134 - DNA, 20 bp, Artificial Sequence
  Description of Artificial Sequence: Synthetic oligonucleotide
  Target: AGXT; (-) strand; PAM type: NRG; PAM sequence: GAG
tcgttcatctcttttgtatg

SEQ ID NO: 10135 - DNA, 20 bp, Artificial Sequence
  Description of Artificial Sequence: Synthetic oligonucleotide
  Target: AGXT; (-) strand; PAM type: NRG; PAM sequence: TGG
aatcgttcatctcttttgta

SEQ ID NO: 10136 - DNA, 20 bp, Artificial Sequence
  Description of Artificial Sequence: Synthetic oligonucleotide
  Target: AGXT; (-) strand; PAM type: NRG; PAM sequence: TAG
agaaaagaaaagaaaagaaa

SEQ ID NO: 10137 - DNA, 20 bp, Artificial Sequence
  Description of Artificial Sequence: Synthetic oligonucleotide
  Target: AGXT; (-) strand; PAM type: NRG; PAM sequence: AAG
aagaaaagaaaagaaaagaa

SEQ ID NO: 10138 - DNA, 20 bp, Artificial Sequence
  Description of Artificial Sequence: Synthetic oligonucleotide
  Target: AGXT; (-) strand; PAM type: NRG; PAM sequence: AAG
aagaaaagaaaagaaaagaa

SEQ ID NO: 10139 - DNA, 20 bp, Artificial Sequence
  Description of Artificial Sequence: Synthetic oligonucleotide
  Target: AGXT; (-) strand; PAM type: NRG; PAM sequence: AAG
aaaaaaagaaaagaaaagaa

SEQ ID NO: 10140 - DNA, 20 bp, Artificial Sequence
  Description of Artificial Sequence: Synthetic oligonucleotide
  Target: AGXT; (-) strand; PAM type: NRG; PAM sequence: AAG
gtctcaaaaaaagaaaagaa

SEQ ID NO: 10141 - DNA, 20 bp, Artificial Sequence
  Description of Artificial Sequence: Synthetic oligonucleotide
  Target: AGXT; (-) strand; PAM type: NRG; PAM sequence: AAG
actccgtctcaaaaaaagaa

SEQ ID NO: 10142 - DNA, 20 bp, Artificial Sequence
  Description of Artificial Sequence: Synthetic oligonucleotide
  Target: AGXT; (-) strand; PAM type: NRG; PAM sequence: AAG
gcgaaactccgtctcaaaaa

SEQ ID NO: 10143 - DNA, 20 bp, Artificial Sequence
  Description of Artificial Sequence: Synthetic oligonucleotide
  Target: AGXT; (-) strand; PAM type: NRG; PAM sequence: GAG
cactccagcctgggcaacaa

SEQ ID NO: 10144 - DNA, 20 bp, Artificial Sequence
  Description of Artificial Sequence: Synthetic oligonucleotide
  Target: AGXT; (-) strand; PAM type: NRG; PAM sequence: AAG
tgcactccagcctgggcaac

SEQ ID NO: 10145 - DNA, 20 bp, Artificial Sequence
  Description of Artificial Sequence: Synthetic oligonucleotide
  Target: AGXT; (-) strand; PAM type: NRG; PAM sequence: GGG
ccaccattgcactccagcct

SEQ ID NO: 10146 - DNA, 20 bp, Artificial Sequence
  Description of Artificial Sequence: Synthetic oligonucleotide
  Target: AGXT; (-) strand; PAM type: NRG; PAM sequence: TGG
cccaccattgcactccagcc

SEQ ID NO: 10147 - DNA, 20 bp, Artificial Sequence
  Description of Artificial Sequence: Synthetic oligonucleotide
  Target: AGXT; (-) strand; PAM type: NRG; PAM sequence: CAG
gagatcccaccattgcactc

SEQ ID NO: 10148 - DNA, 20 bp, Artificial Sequence
  Description of Artificial Sequence: Synthetic oligonucleotide
  Target: AGXT; (-) strand; PAM type: NRG; PAM sequence: GAG
ggtggaggttgcggtaagcc

SEQ ID NO: 10149 - DNA, 20 bp, Artificial Sequence
  Description of Artificial Sequence: Synthetic oligonucleotide
  Target: AGXT; (-) strand; PAM type: NRG; PAM sequence: AAG
tgggaggtggaggttgcggt

SEQ ID NO: 10150 - DNA, 20 bp, Artificial Sequence
  Description of Artificial Sequence: Synthetic oligonucleotide
  Target: AGXT; (-) strand; PAM type: NRG; PAM sequence: CGG
aacctgggaggtggaggttg

SEQ ID NO: 10151 - DNA, 20 bp, Artificial Sequence
  Description of Artificial Sequence: Synthetic oligonucleotide
  Target: AGXT; (-) strand; PAM type: NRG; PAM sequence: AGG
tgcttgaacctgggaggtgg

SEQ ID NO: 10152 - DNA, 20 bp, Artificial Sequence
  Description of Artificial Sequence: Synthetic oligonucleotide
  Target: AGXT; (-) strand; PAM type: NRG; PAM sequence: GAG
ttgcttgaacctgggaggtg

SEQ ID NO: 10153 - DNA, 20 bp, Artificial Sequence
  Description of Artificial Sequence: Synthetic oligonucleotide
  Target: AGXT; (-) strand; PAM type: NRG; PAM sequence: TGG
aattgcttgaacctgggagg

SEQ ID NO: 10154 - DNA, 20 bp, Artificial Sequence
  Description of Artificial Sequence: Synthetic oligonucleotide
  Target: AGXT; (-) strand; PAM type: NRG; PAM sequence: AGG
gagaattgcttgaacctggg

SEQ ID NO: 10155 - DNA, 20 bp, Artificial Sequence
  Description of Artificial Sequence: Synthetic oligonucleotide
  Target: AGXT; (-) strand; PAM type: NRG; PAM sequence: GAG
ggagaattgcttgaacctgg

SEQ ID NO: 10156 - DNA, 20 bp, Artificial Sequence
  Description of Artificial Sequence: Synthetic oligonucleotide
  Target: AGXT; (-) strand; PAM type: NRG; PAM sequence: GGG
caggagaattgcttgaacct

SEQ ID NO: 10157 - DNA, 20 bp, Artificial Sequence
  Description of Artificial Sequence: Synthetic oligonucleotide
  Target: AGXT; (-) strand; PAM type: NRG; PAM sequence: TGG
gcaggagaattgcttgaacc

SEQ ID NO: 10158 - DNA, 20 bp, Artificial Sequence
  Description of Artificial Sequence: Synthetic oligonucleotide
  Target: AGXT; (-) strand; PAM type: NRG; PAM sequence: GAG
tactcgggaggctgaggcag

SEQ ID NO: 10159 - DNA, 20 bp, Artificial Sequence
  Description of Artificial Sequence: Synthetic oligonucleotide
  Target: AGXT; (-) strand; PAM type: NRG; PAM sequence: AGG
gctactcgggaggctgaggc

SEQ ID NO: 10160 - DNA, 20 bp, Artificial Sequence
  Description of Artificial Sequence: Synthetic oligonucleotide
  Target: AGXT; (-) strand; PAM type: NRG; PAM sequence: CAG
agctactcgggaggctgagg

SEQ ID NO: 10161 - DNA, 20 bp, Artificial Sequence
  Description of Artificial Sequence: Synthetic oligonucleotide
  Target: AGXT; (-) strand; PAM type: NRG; PAM sequence: AGG
cccagctactcgggaggctg

SEQ ID NO: 10162 - DNA, 20 bp, Artificial Sequence
  Description of Artificial Sequence: Synthetic oligonucleotide
  Target: AGXT; (-) strand; PAM type: NRG; PAM sequence: GAG
tcccagctactcgggaggct

SEQ ID NO: 10163 - DNA, 20 bp, Artificial Sequence
  Description of Artificial Sequence: Synthetic oligonucleotide
  Target: AGXT; (-) strand; PAM type: NRG; PAM sequence: AGG
tgtaatcccagctactcggg

SEQ ID NO: 10164 - DNA, 20 bp, Artificial Sequence
  Description of Artificial Sequence: Synthetic oligonucleotide
  Target: AGXT; (-) strand; PAM type: NRG; PAM sequence: GAG
ctgtaatcccagctactcgg

SEQ ID NO: 10165 - DNA, 20 bp, Artificial Sequence
  Description of Artificial Sequence: Synthetic oligonucleotide
  Target: AGXT; (-) strand; PAM type: NRG; PAM sequence: GGG
gcctgtaatcccagctactc

SEQ ID NO: 10166 - DNA, 20 bp, Artificial Sequence
  Description of Artificial Sequence: Synthetic oligonucleotide
  Target: AGXT; (-) strand; PAM type: NRG; PAM sequence: CGG
tgcctgtaatcccagctact

SEQ ID NO: 10167 - DNA, 20 bp, Artificial Sequence
  Description of Artificial Sequence: Synthetic oligonucleotide
  Target: AGXT; (-) strand; PAM type: NRG; PAM sequence: CAG
gtggcaggtgcctgtaatcc

SEQ ID NO: 10168 - DNA, 20 bp, Artificial Sequence
  Description of Artificial Sequence: Synthetic oligonucleotide
  Target: AGXT; (-) strand; PAM type: NRG; PAM sequence: AGG
aattagccgggcatggtggc

SEQ ID NO: 10169 - DNA, 20 bp, Artificial Sequence
  Description of Artificial Sequence: Synthetic oligonucleotide
  Target: AGXT; (-) strand; PAM type: NRG; PAM sequence: CAG
aaattagccgggcatggtgg

SEQ ID NO: 10170 - DNA, 20 bp, Artificial Sequence
  Description of Artificial Sequence: Synthetic oligonucleotide
  Target: AGXT; (-) strand; PAM type: NRG; PAM sequence: TGG
aaaaaattagccgggcatgg

SEQ ID NO: 10171 - DNA, 20 bp, Artificial Sequence
  Description of Artificial Sequence: Synthetic oligonucleotide
  Target: AGXT; (-) strand; PAM type: NRG; PAM sequence: TGG
tacaaaaaattagccgggca

SEQ ID NO: 10172 - DNA, 20 bp, Artificial Sequence
  Description of Artificial Sequence: Synthetic oligonucleotide
  Target: AGXT; (-) strand; PAM type: NRG; PAM sequence: GGG
aaaaatacaaaaaattagcc

SEQ ID NO: 10173 - DNA, 20 bp, Artificial Sequence
  Description of Artificial Sequence: Synthetic oligonucleotide
  Target: AGXT; (-) strand; PAM type: NRG; PAM sequence: CGG
taaaaatacaaaaaattagc

SEQ ID NO: 10174 - DNA, 20 bp, Artificial Sequence
  Description of Artificial Sequence: Synthetic oligonucleotide
  Target: AGXT; (-) strand; PAM type: NRG; PAM sequence: TAG
ctactaaaaatacaaaaaat

SEQ ID NO: 10175 - DNA, 20 bp, Artificial Sequence
  Description of Artificial Sequence: Synthetic oligonucleotide
  Target: AGXT; (-) strand; PAM type: NRG; PAM sequence: TGG
cgagaccagcctggccaaca

SEQ ID NO: 10176 - DNA, 20 bp, Artificial Sequence
  Description of Artificial Sequence: Synthetic oligonucleotide
  Target: AGXT; (-) strand; PAM type: NRG; PAM sequence: TGG
tcaggagttcgagaccagcc

SEQ ID NO: 10177 - DNA, 20 bp, Artificial Sequence
  Description of Artificial Sequence: Synthetic oligonucleotide
  Target: AGXT; (-) strand; PAM type: NRG; PAM sequence: CAG
tgaggtcaggagttcgagac

SEQ ID NO: 10178 - DNA, 20 bp, Artificial Sequence
  Description of Artificial Sequence: Synthetic oligonucleotide
  Target: AGXT; (-) strand; PAM type: NRG; PAM sequence: GAG
tcacctgaggtcaggagttc

SEQ ID NO: 10179 - DNA, 20 bp, Artificial Sequence
  Description of Artificial Sequence: Synthetic oligonucleotide
  Target: AGXT; (-) strand; PAM type: NRG; PAM sequence: GAG
ggtggatcacctgaggtcag

SEQ ID NO: 10180 - DNA, 20 bp, Artificial Sequence
  Description of Artificial Sequence: Synthetic oligonucleotide
  Target: AGXT; (-) strand; PAM type: NRG; PAM sequence: AGG
tgggtggatcacctgaggtc

SEQ ID NO: 10181 - DNA, 20 bp, Artificial Sequence
  Description of Artificial Sequence: Synthetic oligonucleotide
  Target: AGXT; (-) strand; PAM type: NRG; PAM sequence: CAG
gtgggtggatcacctgaggt

SEQ ID NO: 10182 - DNA, 20 bp, Artificial Sequence
  Description of Artificial Sequence: Synthetic oligonucleotide
  Target: AGXT; (-) strand; PAM type: NRG; PAM sequence: AGG
cggggtgggtggatcacctg

SEQ ID NO: 10183 - DNA, 20 bp, Artificial Sequence
  Description of Artificial Sequence: Synthetic oligonucleotide
  Target: AGXT; (-) strand; PAM type: NRG; PAM sequence: GAG
ccggggtgggtggatcacct

SEQ ID NO: 10184 - DNA, 20 bp, Artificial Sequence
  Description of Artificial Sequence: Synthetic oligonucleotide
  Target: AGXT; (-) strand; PAM type: NRG; PAM sequence: TGG
ctttgggaggccggggtggg

SEQ ID NO: 10185 - DNA, 20 bp, Artificial Sequence
  Description of Artificial Sequence: Synthetic oligonucleotide
  Target: AGXT; (-) strand; PAM type: NRG; PAM sequence: GGG
gcactttgggaggccggggt

SEQ ID NO: 10186 - DNA, 20 bp, Artificial Sequence
  Description of Artificial Sequence: Synthetic oligonucleotide
  Target: AGXT; (-) strand; PAM type: NRG; PAM sequence: TGG
agcactttgggaggccgggg

SEQ ID NO: 10187 - DNA, 20 bp, Artificial Sequence
  Description of Artificial Sequence: Synthetic oligonucleotide
  Target: AGXT; (-) strand; PAM type: NRG; PAM sequence: GGG
cccagcactttgggaggccg

SEQ ID NO: 10188 - DNA, 20 bp, Artificial Sequence
  Description of Artificial Sequence: Synthetic oligonucleotide
  Target: AGXT; (-) strand; PAM type: NRG; PAM sequence: GGG
tcccagcactttgggaggcc

SEQ ID NO: 10189 - DNA, 20 bp, Artificial Sequence
  Description of Artificial Sequence: Synthetic oligonucleotide
  Target: AGXT; (-) strand; PAM type: NRG; PAM sequence: CGG
atcccagcactttgggaggc

SEQ ID NO: 10190 - DNA, 20 bp, Artificial Sequence
  Description of Artificial Sequence: Synthetic oligonucleotide
  Target: AGXT; (-) strand; PAM type: NRG; PAM sequence: AGG
tgtaatcccagcactttggg

SEQ ID NO: 10191 - DNA, 20 bp, Artificial Sequence
  Description of Artificial Sequence: Synthetic oligonucleotide
  Target: AGXT; (-) strand; PAM type: NRG; PAM sequence: GAG
ctgtaatcccagcactttgg

SEQ ID NO: 10192 - DNA, 20 bp, Artificial Sequence
  Description of Artificial Sequence: Synthetic oligonucleotide
  Target: AGXT; (-) strand; PAM type: NRG; PAM sequence: GGG
atctgtaatcccagcacttt

SEQ ID NO: 10193 - DNA, 20 bp, Artificial Sequence
  Description of Artificial Sequence: Synthetic oligonucleotide
  Target: AGXT; (-) strand; PAM type: NRG; PAM sequence: TGG
catctgtaatcccagcactt

SEQ ID NO: 10194 - DNA, 20 bp, Artificial Sequence
  Description of Artificial Sequence: Synthetic oligonucleotide
  Target: AGXT; (-) strand; PAM type: NRG; PAM sequence: CAG
gtggctcacatctgtaatcc

SEQ ID NO: 10195 - DNA, 20 bp, Artificial Sequence
  Description of Artificial Sequence: Synthetic oligonucleotide
  Target: AGXT; (-) strand; PAM type: NRG; PAM sequence: TGG
agaaactgggccaggcgcgg

SEQ ID NO: 10196 - DNA, 20 bp, Artificial Sequence
  Description of Artificial Sequence: Synthetic oligonucleotide
  Target: AGXT; (-) strand; PAM type: NRG; PAM sequence: CGG
aatagaaactgggccaggcg

SEQ ID NO: 10197 - DNA, 20 bp, Artificial Sequence
  Description of Artificial Sequence: Synthetic oligonucleotide
  Target: AGXT; (-) strand; PAM type: NRG; PAM sequence: AGG
caagaaatagaaactgggcc

SEQ ID NO: 10198 - DNA, 20 bp, Artificial Sequence
  Description of Artificial Sequence: Synthetic oligonucleotide
  Target: AGXT; (-) strand; PAM type: NRG; PAM sequence: CAG
tcaagaaatagaaactgggc

SEQ ID NO: 10199 - DNA, 20 bp, Artificial Sequence
  Description of Artificial Sequence: Synthetic oligonucleotide
  Target: AGXT; (-) strand; PAM type: NRG; PAM sequence: GGG
agtatcaagaaatagaaact

SEQ ID NO: 10200 - DNA, 20 bp, Artificial Sequence
  Description of Artificial Sequence: Synthetic oligonucleotide
  Target: AGXT; (-) strand; PAM type: NRG; PAM sequence: TGG
gagtatcaagaaatagaaac

SEQ ID NO: 10201 - DNA, 20 bp, Artificial Sequence
  Description of Artificial Sequence: Synthetic oligonucleotide
  Target: AGXT; (-) strand; PAM type: NRG; PAM sequence: TAG
atgggcagagtatcaagaaa

SEQ ID NO: 10202 - DNA, 20 bp, Artificial Sequence
  Description of Artificial Sequence: Synthetic oligonucleotide
  Target: AGXT; (-) strand; PAM type: NRG; PAM sequence: AAG
ctccgcatgggcagagtatc

SEQ ID NO: 10203 - DNA, 20 bp, Artificial Sequence
  Description of Artificial Sequence: Synthetic oligonucleotide
  Target: AGXT; (-) strand; PAM type: NRG; PAM sequence: GAG
gaaaatcctccgcatgggca

SEQ ID NO: 10204 - DNA, 20 bp, Artificial Sequence
  Description of Artificial Sequence: Synthetic oligonucleotide
  Target: AGXT; (-) strand; PAM type: NRG; PAM sequence: CAG
gggaaaatcctccgcatggg

SEQ ID NO: 10205 - DNA, 20 bp, Artificial Sequence
  Description of Artificial Sequence: Synthetic oligonucleotide
  Target: AGXT; (-) strand; PAM type: NRG; PAM sequence: GGG
tgagggaaaatcctccgcat

SEQ ID NO: 10206 - DNA, 20 bp, Artificial Sequence
  Description of Artificial Sequence: Synthetic oligonucleotide
  Target: AGXT; (-) strand; PAM type: NRG; PAM sequence: TGG
gtgagggaaaatcctccgca

SEQ ID NO: 10207 - DNA, 20 bp, Artificial Sequence
  Description of Artificial Sequence: Synthetic oligonucleotide
  Target: AGXT; (-) strand; PAM type: NRG; PAM sequence: GGG
ttcctagaagagagtggtga

SEQ ID NO: 10208 - DNA, 20 bp, Artificial Sequence
  Description of Artificial Sequence: Synthetic oligonucleotide
  Target: AGXT; (-) strand; PAM type: NRG; PAM sequence: AGG
gttcctagaagagagtggtg

SEQ ID NO: 10209 - DNA, 20 bp, Artificial Sequence
  Description of Artificial Sequence: Synthetic oligonucleotide
  Target: AGXT; (-) strand; PAM type: NRG; PAM sequence: GAG
ggttcctagaagagagtggt

SEQ ID NO: 10210 - DNA, 20 bp, Artificial Sequence
  Description of Artificial Sequence: Synthetic oligonucleotide
  Target: AGXT; (-) strand; PAM type: NRG; PAM sequence: TGG
tcagggttcctagaagagag

SEQ ID NO: 10211 - DNA, 20 bp, Artificial Sequence
  Description of Artificial Sequence: Synthetic oligonucleotide
  Target: AGXT; (-) strand; PAM type: NRG; PAM sequence: GAG
aactcagggttcctagaaga

SEQ ID NO: 10212 - DNA, 20 bp, Artificial Sequence
  Description of Artificial Sequence: Synthetic oligonucleotide
  Target: AGXT; (-) strand; PAM type: NRG; PAM sequence: GAG
ccaactcagggttcctagaa

SEQ ID NO: 10213 - DNA, 20 bp, Artificial Sequence
  Description of Artificial Sequence: Synthetic oligonucleotide
  Target: AGXT; (-) strand; PAM type: NRG; PAM sequence: AAG
tcccaactcagggttcctag

SEQ ID NO: 10214 - DNA, 20 bp, Artificial Sequence
  Description of Artificial Sequence: Synthetic oligonucleotide
  Target: AGXT; (-) strand; PAM type: NRG; PAM sequence: TAG
ctttcccaactcagggttcc

SEQ ID NO: 10215 - DNA, 20 bp, Artificial Sequence
  Description of Artificial Sequence: Synthetic oligonucleotide
  Target: AGXT; (-) strand; PAM type: NRG; PAM sequence: GGG
aaatggactttcccaactca

SEQ ID NO: 10216 - DNA, 20 bp, Artificial Sequence
  Description of Artificial Sequence: Synthetic oligonucleotide
  Target: AGXT; (-) strand; PAM type: NRG; PAM sequence: AGG
aaaatggactttcccaactc

SEQ ID NO: 10217 - DNA, 20 bp, Artificial Sequence
  Description of Artificial Sequence: Synthetic oligonucleotide
  Target: AGXT; (-) strand; PAM type: NRG; PAM sequence: CAG
caaaatggactttcccaact

SEQ ID NO: 10218 - DNA, 20 bp, Artificial Sequence
  Description of Artificial Sequence: Synthetic oligonucleotide
  Target: AGXT; (-) strand; PAM type: NRG; PAM sequence: TGG
tcttttggtgcgaaccaaaa

SEQ ID NO: 10219 - DNA, 20 bp, Artificial Sequence
  Description of Artificial Sequence: Synthetic oligonucleotide
  Target: AGXT; (-) strand; PAM type: NRG; PAM sequence: TGG
gatatgatggcttggtcttt

SEQ ID NO: 10220 - DNA, 20 bp, Artificial Sequence
  Description of Artificial Sequence: Synthetic oligonucleotide
  Target: AGXT; (+) strand; PAM type: NRG; PAM sequence: TGG
aacaaactaaatcaactgct

SEQ ID NO: 10221 - DNA, 20 bp, Artificial Sequence
  Description of Artificial Sequence: Synthetic oligonucleotide
  Target: AGXT; (+) strand; PAM type: NRG; PAM sequence: CAG
acccaatcccaccaaaaccc

SEQ ID NO: 10222 - DNA, 20 bp, Artificial Sequence
  Description of Artificial Sequence: Synthetic oligonucleotide
  Target: AGXT; (+) strand; PAM type: NRG; PAM sequence: AAG
acaccccacaaaatttacaa

SEQ ID NO: 10223 - DNA, 20 bp, Artificial Sequence
  Description of Artificial Sequence: Synthetic oligonucleotide
  Target: AGXT; (+) strand; PAM type: NRG; PAM sequence: AGG
caccccacaaaatttacaaa

SEQ ID NO: 10224 - DNA, 20 bp, Artificial Sequence
  Description of Artificial Sequence: Synthetic oligonucleotide
  Target: AGXT; (+) strand; PAM type: NRG; PAM sequence: CAG
atttacaaaaggcactaaaa

SEQ ID NO: 10225 - DNA, 20 bp, Artificial Sequence
  Description of Artificial Sequence: Synthetic oligonucleotide
  Target: AGXT; (+) strand; PAM type: NRG; PAM sequence: AGG
tttacaaaaggcactaaaac

SEQ ID NO: 10226 - DNA, 20 bp, Artificial Sequence
  Description of Artificial Sequence: Synthetic oligonucleotide
  Target: AGXT; (+) strand; PAM type: NRG; PAM sequence: GGG
ttacaaaaggcactaaaaca

SEQ ID NO: 10227 - DNA, 20 bp, Artificial Sequence
  Description of Artificial Sequence: Synthetic oligonucleotide
  Target: AGXT; (+) strand; PAM type: NRG; PAM sequence: AAG
gggtttcacattcattcctg

SEQ ID NO: 10228 - DNA, 20 bp, Artificial Sequence
  Description of Artificial Sequence: Synthetic oligonucleotide
  Target: AGXT; (+) strand; PAM type: NRG; PAM sequence: AGG
ggtttcacattcattcctga

SEQ ID NO: 10229 - DNA, 20 bp, Artificial Sequence
  Description of Artificial Sequence: Synthetic oligonucleotide
  Target: AGXT; (+) strand; PAM type: NRG; PAM sequence: TGG
tcacattcattcctgaagga

SEQ ID NO: 10230 - DNA, 20 bp, Artificial Sequence
  Description of Artificial Sequence: Synthetic oligonucleotide
  Target: AGXT; (+) strand; PAM type: NRG; PAM sequence: GAG
aaaataaacttctcctccct

SEQ ID NO: 10231 - DNA, 20 bp, Artificial Sequence
  Description of Artificial Sequence: Synthetic oligonucleotide
  Target: AGXT; (+) strand; PAM type: NRG; PAM sequence: AGG
aaataaacttctcctccctg

SEQ ID NO: 10232 - DNA, 20 bp, Artificial Sequence
  Description of Artificial Sequence: Synthetic oligonucleotide
  Target: AGXT; (+) strand; PAM type: NRG; PAM sequence: TGG
tcctccctgaggttccacaa

SEQ ID NO: 10233 - DNA, 20 bp, Artificial Sequence
  Description of Artificial Sequence: Synthetic oligonucleotide
  Target: AGXT; (+) strand; PAM type: NRG; PAM sequence: AAG
aatcctctaaaatctccatc

SEQ ID NO: 10234 - DNA, 20 bp, Artificial Sequence
  Description of Artificial Sequence: Synthetic oligonucleotide
  Target: AGXT; (+) strand; PAM type: NRG; PAM sequence: TGG
tctccatcaagctaaccacc

SEQ ID NO: 10235 - DNA, 20 bp, Artificial Sequence
  Description of Artificial Sequence: Synthetic oligonucleotide
  Target: AGXT; (+) strand; PAM type: NRG; PAM sequence: GGG
ctccatcaagctaaccacct

SEQ ID NO: 10236 - DNA, 20 bp, Artificial Sequence
  Description of Artificial Sequence: Synthetic oligonucleotide
  Target: AGXT; (+) strand; PAM type: NRG; PAM sequence: GGG
tccatcaagctaaccacctg

SEQ ID NO: 10237 - DNA, 20 bp, Artificial Sequence
  Description of Artificial Sequence: Synthetic oligonucleotide
  Target: AGXT; (+) strand; PAM type: NRG; PAM sequence: GGG
ccatcaagctaaccacctgg

SEQ ID NO: 10238 - DNA, 20 bp, Artificial Sequence
  Description of Artificial Sequence: Synthetic oligonucleotide
  Target: AGXT; (+) strand; PAM type: NRG; PAM sequence: TGG
tcaagctaaccacctggggg

SEQ ID NO: 10239 - DNA, 20 bp, Artificial Sequence
  Description of Artificial Sequence: Synthetic oligonucleotide
  Target: AGXT; (+) strand; PAM type: NRG; PAM sequence: AAG
cctgggggtggaaactttac

SEQ ID NO: 10240 - DNA, 20 bp, Artificial Sequence
  Description of Artificial Sequence: Synthetic oligonucleotide
  Target: AGXT; (+) strand; PAM type: NRG; PAM sequence: AAG
gtggaaactttacaagcctt

SEQ ID NO: 10241 - DNA, 20 bp, Artificial Sequence
  Description of Artificial Sequence: Synthetic oligonucleotide
  Target: AGXT; (+) strand; PAM type: NRG; PAM sequence: GAG
ggaaactttacaagccttaa

SEQ ID NO: 10242 - DNA, 20 bp, Artificial Sequence
  Description of Artificial Sequence: Synthetic oligonucleotide
  Target: AGXT; (+) strand; PAM type: NRG; PAM sequence: AAG
cttaagagatcctctttttc

SEQ ID NO: 10243 - DNA, 20 bp, Artificial Sequence
  Description of Artificial Sequence: Synthetic oligonucleotide
  Target: AGXT; (+) strand; PAM type: NRG; PAM sequence: AGG
ttaagagatcctctttttca

SEQ ID NO: 10244 - DNA, 20 bp, Artificial Sequence
  Description of Artificial Sequence: Synthetic oligonucleotide
  Target: AGXT; (+) strand; PAM type: NRG; PAM sequence: GGG
taagagatcctctttttcaa

SEQ ID NO: 10245 - DNA, 20 bp, Artificial Sequence
  Description of Artificial Sequence: Synthetic oligonucleotide
  Target: AGXT; (+) strand; PAM type: NRG; PAM sequence: TAG
tctttttcaagggcctaacc

SEQ ID NO: 10246 - DNA, 20 bp, Artificial Sequence
  Description of Artificial Sequence: Synthetic oligonucleotide
  Target: AGXT; (+) strand; PAM type: NRG; PAM sequence: TAG
ttcaagggcctaacctagcc

SEQ ID NO: 10247 - DNA, 20 bp, Artificial Sequence
  Description of Artificial Sequence: Synthetic oligonucleotide
  Target: AGXT; (+) strand; PAM type: NRG; PAM sequence: TGG
ctagcctagccccaactcta

SEQ ID NO: 10248 - DNA, 20 bp, Artificial Sequence
  Description of Artificial Sequence: Synthetic oligonucleotide
  Target: AGXT; (+) strand; PAM type: NRG; PAM sequence: GGG
tagcctagccccaactctat

SEQ ID NO: 10249 - DNA, 20 bp, Artificial Sequence
  Description of Artificial Sequence: Synthetic oligonucleotide
  Target: AGXT; (+) strand; PAM type: NRG; PAM sequence: GAG
tttgctgtcaatcaaatcct

SEQ ID NO: 10250 - DNA, 20 bp, Artificial Sequence
  Description of Artificial Sequence: Synthetic oligonucleotide
  Target: AGXT; (+) strand; PAM type: NRG; PAM sequence: AGG
ttgctgtcaatcaaatcctg

SEQ ID NO: 10251 - DNA, 20 bp, Artificial Sequence
  Description of Artificial Sequence: Synthetic oligonucleotide
  Target: AGXT; (+) strand; PAM type: NRG; PAM sequence: GGG
tgctgtcaatcaaatcctga

SEQ ID NO: 10252 - DNA, 20 bp, Artificial Sequence
  Description of Artificial Sequence: Synthetic oligonucleotide
  Target: AGXT; (+) strand; PAM type: NRG; PAM sequence: TAG
ctcctccaacctattcaacg

SEQ ID NO: 10253 - DNA, 20 bp, Artificial Sequence
  Description of Artificial Sequence: Synthetic oligonucleotide
  Target: AGXT; (+) strand; PAM type: NRG; PAM sequence: GAG
cctccaacctattcaacgta

SEQ ID NO: 10254 - DNA, 20 bp, Artificial Sequence
  Description of Artificial Sequence: Synthetic oligonucleotide
  Target: AGXT; (+) strand; PAM type: NRG; PAM sequence: AGG
ctccaacctattcaacgtag

SEQ ID NO: 10255 - DNA, 20 bp, Artificial Sequence
  Description of Artificial Sequence: Synthetic oligonucleotide
  Target: AGXT; (+) strand; PAM type: NRG; PAM sequence: GGG
tccaacctattcaacgtaga

SEQ ID NO: 10256 - DNA, 20 bp, Artificial Sequence
  Description of Artificial Sequence: Synthetic oligonucleotide
  Target: AGXT; (+) strand; PAM type: NRG; PAM sequence: CAG
tcaacgtagagggcctgtcc

SEQ ID NO: 10257 - DNA, 20 bp, Artificial Sequence
  Description of Artificial Sequence: Synthetic oligonucleotide
  Target: AGXT; (+) strand; PAM type: NRG; PAM sequence: AGG
caacgtagagggcctgtccc

SEQ ID NO: 10258 - DNA, 20 bp, Artificial Sequence
  Description of Artificial Sequence: Synthetic oligonucleotide
  Target: AGXT; (+) strand; PAM type: NRG; PAM sequence: GGG
aacgtagagggcctgtccca

SEQ ID NO: 10259 - DNA, 20 bp, Artificial Sequence
  Description of Artificial Sequence: Synthetic oligonucleotide
  Target: AGXT; (+) strand; PAM type: NRG; PAM sequence: GGG
acgtagagggcctgtcccag

SEQ ID NO: 10260 - DNA, 20 bp, Artificial Sequence
  Description of Artificial Sequence: Synthetic oligonucleotide
  Target: AGXT; (+) strand; PAM type: NRG; PAM sequence: TGG
ggcctgtcccaggggcgtac

SEQ ID NO: 10261 - DNA, 20 bp, Artificial Sequence
  Description of Artificial Sequence: Synthetic oligonucleotide
  Target: AGXT; (+) strand; PAM type: NRG; PAM sequence: AAG
tgtcccaggggcgtactggc

SEQ ID NO: 10262 - DNA, 20 bp, Artificial Sequence
  Description of Artificial Sequence: Synthetic oligonucleotide
  Target: AGXT; (+) strand; PAM type: NRG; PAM sequence: AAG
ctgcccacatgccctctcat

SEQ ID NO: 10263 - DNA, 20 bp, Artificial Sequence
  Description of Artificial Sequence: Synthetic oligonucleotide
  Target: AGXT; (+) strand; PAM type: NRG; PAM sequence: AGG
tgcccacatgccctctcata

SEQ ID NO: 10264 - DNA, 20 bp, Artificial Sequence
  Description of Artificial Sequence: Synthetic oligonucleotide
  Target: AGXT; (+) strand; PAM type: NRG; PAM sequence: GGG
gcccacatgccctctcataa

SEQ ID NO: 10265 - DNA, 20 bp, Artificial Sequence
  Description of Artificial Sequence: Synthetic oligonucleotide
  Target: AGXT; (+) strand; PAM type: NRG; PAM sequence: CAG
atgccctctcataagggatt

SEQ ID NO: 10266 - DNA, 20 bp, Artificial Sequence
  Description of Artificial Sequence: Synthetic oligonucleotide
  Target: AGXT; (+) strand; PAM type: NRG; PAM sequence: TAG
taagggattcagataccttt

SEQ ID NO: 10267 - DNA, 20 bp, Artificial Sequence
  Description of Artificial Sequence: Synthetic oligonucleotide
  Target: AGXT; (+) strand; PAM type: NRG; PAM sequence: TAG
cagataccttttagtcttta

SEQ ID NO: 10268 - DNA, 20 bp, Artificial Sequence
  Description of Artificial Sequence: Synthetic oligonucleotide
  Target: AGXT; (+) strand; PAM type: NRG; PAM sequence: AAG
gtctttatagacactttcac

SEQ ID NO: 10269 - DNA, 20 bp, Artificial Sequence
  Description of Artificial Sequence: Synthetic oligonucleotide
  Target: AGXT; (+) strand; PAM type: NRG; PAM sequence: TGG
ttatagacactttcacaagc

SEQ ID NO: 10270 - DNA, 20 bp, Artificial Sequence
  Description of Artificial Sequence: Synthetic oligonucleotide
  Target: AGXT; (+) strand; PAM type: NRG; PAM sequence: AAG
cactttcacaagctggacta

SEQ ID NO: 10271 - DNA, 20 bp, Artificial Sequence
  Description of Artificial Sequence: Synthetic oligonucleotide
  Target: AGXT; (+) strand; PAM type: NRG; PAM sequence: CAG
ctaaagccttcccactcgaa

SEQ ID NO: 10272 - DNA, 20 bp, Artificial Sequence
  Description of Artificial Sequence: Synthetic oligonucleotide
  Target: AGXT; (+) strand; PAM type: NRG; PAM sequence: AAG
agccttcccactcgaacaga

SEQ ID NO: 10273 - DNA, 20 bp, Artificial Sequence
  Description of Artificial Sequence: Synthetic oligonucleotide
  Target: AGXT; (+) strand; PAM type: NRG; PAM sequence: GAG
ccttcccactcgaacagaaa

SEQ ID NO: 10274 - DNA, 20 bp, Artificial Sequence
  Description of Artificial Sequence: Synthetic oligonucleotide
  Target: AGXT; (+) strand; PAM type: NRG; PAM sequence: CAG
cactcgaacagaaagagcat

SEQ ID NO: 10275 - DNA, 20 bp, Artificial Sequence
  Description of Artificial Sequence: Synthetic oligonucleotide
  Target: AGXT; (+) strand; PAM type: NRG; PAM sequence: AAG
tcgaacagaaagagcatcag

SEQ ID NO: 10276 - DNA, 20 bp, Artificial Sequence
  Description of Artificial Sequence: Synthetic oligonucleotide
  Target: AGXT; (+) strand; PAM type: NRG; PAM sequence: CGG
aagagcatcagaagtaacta

SEQ ID NO: 10277 - DNA, 20 bp, Artificial Sequence
  Description of Artificial Sequence: Synthetic oligonucleotide
  Target: AGXT; (+) strand; PAM type: NRG; PAM sequence: TAG
agaagtaactacggctcttt

SEQ ID NO: 10278 - DNA, 20 bp, Artificial Sequence
  Description of Artificial Sequence: Synthetic oligonucleotide
  Target: AGXT; (+) strand; PAM type: NRG; PAM sequence: TGG
gaacacattattcctcgatt

SEQ ID NO: 10279 - DNA, 20 bp, Artificial Sequence
  Description of Artificial Sequence: Synthetic oligonucleotide
  Target: AGXT; (+) strand; PAM type: NRG; PAM sequence: GGG
aacacattattcctcgattt

SEQ ID NO: 10280 - DNA, 20 bp, Artificial Sequence
  Description of Artificial Sequence: Synthetic oligonucleotide
  Target: AGXT; (+) strand; PAM type: NRG; PAM sequence: GGG
acacattattcctcgatttg

SEQ ID NO: 10281 - DNA, 20 bp, Artificial Sequence
  Description of Artificial Sequence: Synthetic oligonucleotide
  Target: AGXT; (+) strand; PAM type: NRG; PAM sequence: CAG
ggtccctcaatccctccaat

SEQ ID NO: 10282 - DNA, 20 bp, Artificial Sequence
  Description of Artificial Sequence: Synthetic oligonucleotide
  Target: AGXT; (+) strand; PAM type: NRG; PAM sequence: TGG
caatccctccaatcagacaa

SEQ ID NO: 10283 - DNA, 20 bp, Artificial Sequence
  Description of Artificial Sequence: Synthetic oligonucleotide
  Target: AGXT; (+) strand; PAM type: NRG; PAM sequence: TGG
cctccaatcagacaatggcc

SEQ ID NO: 10284 - DNA, 20 bp, Artificial Sequence
  Description of Artificial Sequence: Synthetic oligonucleotide
  Target: AGXT; (+) strand; PAM type: NRG; PAM sequence: CAG
ctttatttcttctattactc

SEQ ID NO: 10285 - DNA, 20 bp, Artificial Sequence
  Description of Artificial Sequence: Synthetic oligonucleotide
  Target: AGXT; (+) strand; PAM type: NRG; PAM sequence: AGG
tttatttcttctattactcc

SEQ ID NO: 10286 - DNA, 20 bp, Artificial Sequence
  Description of Artificial Sequence: Synthetic oligonucleotide
  Target: AGXT; (+) strand; PAM type: NRG; PAM sequence: CAG
tcttctattactccaggaat

SEQ ID NO: 10287 - DNA, 20 bp, Artificial Sequence
  Description of Artificial Sequence: Synthetic oligonucleotide
  Target: AGXT; (+) strand; PAM type: NRG; PAM sequence: GAG
ctattactccaggaatcagt

SEQ ID NO: 10288 - DNA, 20 bp, Artificial Sequence
  Description of Artificial Sequence: Synthetic oligonucleotide
  Target: AGXT; (+) strand; PAM type: NRG; PAM sequence: AGG
tattactccaggaatcagtg

SEQ ID NO: 10289 - DNA, 20 bp, Artificial Sequence
  Description of Artificial Sequence: Synthetic oligonucleotide
  Target: AGXT; (+) strand; PAM type: NRG; PAM sequence: CAG
tacatgctgcttaccaccca

SEQ ID NO: 10290 - DNA, 20 bp, Artificial Sequence
  Description of Artificial Sequence: Synthetic oligonucleotide
  Target: AGXT; (+) strand; PAM type: NRG; PAM sequence: AAG
cttaccacccacagtcatcc

SEQ ID NO: 10291 - DNA, 20 bp, Artificial Sequence
  Description of Artificial Sequence: Synthetic oligonucleotide
  Target: AGXT; (+) strand; PAM type: NRG; PAM sequence: AGG
ttaccacccacagtcatcca

SEQ ID NO: 10292 - DNA, 20 bp, Artificial Sequence
  Description of Artificial Sequence: Synthetic oligonucleotide
  Target: AGXT; (+) strand; PAM type: NRG; PAM sequence: GGG
taccacccacagtcatccaa

SEQ ID NO: 10293 - DNA, 20 bp, Artificial Sequence
  Description of Artificial Sequence: Synthetic oligonucleotide
  Target: AGXT; (+) strand; PAM type: NRG; PAM sequence: AAG
cccacagtcatccaagggcc

SEQ ID NO: 10294 - DNA, 20 bp, Artificial Sequence
  Description of Artificial Sequence: Synthetic oligonucleotide
  Target: AGXT; (+) strand; PAM type: NRG; PAM sequence: TAG
cagtcatccaagggccaagc

SEQ ID NO: 10295 - DNA, 20 bp, Artificial Sequence
  Description of Artificial Sequence: Synthetic oligonucleotide
  Target: AGXT; (+) strand; PAM type: NRG; PAM sequence: AAG
ctttgaaaacccttctcact

SEQ ID NO: 10296 - DNA, 20 bp, Artificial Sequence
  Description of Artificial Sequence: Synthetic oligonucleotide
  Target: AGXT; (+) strand; PAM type: NRG; PAM sequence: TAG
ccttctcactaagctctcta

SEQ ID NO: 10297 - DNA, 20 bp, Artificial Sequence
  Description of Artificial Sequence: Synthetic oligonucleotide
  Target: AGXT; (+) strand; PAM type: NRG; PAM sequence: TGG
ctatagaaactcaactgttt

SEQ ID NO: 10298 - DNA, 20 bp, Artificial Sequence
  Description of Artificial Sequence: Synthetic oligonucleotide
  Target: AGXT; (+) strand; PAM type: NRG; PAM sequence: AAG
tttcttcctattgccctgtt

SEQ ID NO: 10299 - DNA, 20 bp, Artificial Sequence
  Description of Artificial Sequence: Synthetic oligonucleotide
  Target: AGXT; (+) strand; PAM type: NRG; PAM sequence: TAG
cctattgccctgttaagatc

SEQ ID NO: 10300 - DNA, 20 bp, Artificial Sequence
  Description of Artificial Sequence: Synthetic oligonucleotide
  Target: AGXT; (+) strand; PAM type: NRG; PAM sequence: GAG
tattgccctgttaagatcta

SEQ ID NO: 10301 - DNA, 20 bp, Artificial Sequence
  Description of Artificial Sequence: Synthetic oligonucleotide
  Target: AGXT; (+) strand; PAM type: NRG; PAM sequence: AAG
aagatctagagtaattccca

SEQ ID NO: 10302 - DNA, 20 bp, Artificial Sequence
  Description of Artificial Sequence: Synthetic oligonucleotide
  Target: AGXT; (+) strand; PAM type: NRG; PAM sequence: AGG
agatctagagtaattcccaa

SEQ ID NO: 10303 - DNA, 20 bp, Artificial Sequence
  Description of Artificial Sequence: Synthetic oligonucleotide
  Target: AGXT; (+) strand; PAM type: NRG; PAM sequence: TAG
ccaaaggtttcaacccacct

SEQ ID NO: 10304 - DNA, 20 bp, Artificial Sequence
  Description of Artificial Sequence: Synthetic oligonucleotide
  Target: AGXT; (+) strand; PAM type: NRG; PAM sequence: TGG
agcccttttgaaattattta

SEQ ID NO: 10305 - DNA, 20 bp, Artificial Sequence
  Description of Artificial Sequence: Synthetic oligonucleotide
  Target: AGXT; (+) strand; PAM type: NRG; PAM sequence: CGG
tggatgcccctttttacaaa

SEQ ID NO: 10306 - DNA, 20 bp, Artificial Sequence
  Description of Artificial Sequence: Synthetic oligonucleotide
  Target: AGXT; (+) strand; PAM type: NRG; PAM sequence: CAG
aacggacttattacttgatc

SEQ ID NO: 10307 - DNA, 20 bp, Artificial Sequence
  Description of Artificial Sequence: Synthetic oligonucleotide
  Target: AGXT; (+) strand; PAM type: NRG; PAM sequence: GAG
cggacttattacttgatcca

SEQ ID NO: 10308 - DNA, 20 bp, Artificial Sequence
  Description of Artificial Sequence: Synthetic oligonucleotide
  Target: AGXT; (+) strand; PAM type: NRG; PAM sequence: AGG
ggacttattacttgatccag

SEQ ID NO: 10309 - DNA, 20 bp, Artificial Sequence
  Description of Artificial Sequence: Synthetic oligonucleotide
  Target: AGXT; (+) strand; PAM type: NRG; PAM sequence: TGG
gtctcaatgtgatgcctccc

SEQ ID NO: 10310 - DNA, 20 bp, Artificial Sequence
  Description of Artificial Sequence: Synthetic oligonucleotide
  Target: AGXT; (+) strand; PAM type: NRG; PAM sequence: GGG
tctcaatgtgatgcctccct

SEQ ID NO: 10311 - DNA, 20 bp, Artificial Sequence
  Description of Artificial Sequence: Synthetic oligonucleotide
  Target: AGXT; (+) strand; PAM type: NRG; PAM sequence: CAG
gcctccctgggcaaactatc

SEQ ID NO: 10312 - DNA, 20 bp, Artificial Sequence
  Description of Artificial Sequence: Synthetic oligonucleotide
  Target: AGXT; (+) strand; PAM type: NRG; PAM sequence: AGG
cctccctgggcaaactatcc

SEQ ID NO: 10313 - DNA, 20 bp, Artificial Sequence
  Description of Artificial Sequence: Synthetic oligonucleotide
  Target: AGXT; (+) strand; PAM type: NRG; PAM sequence: CAG
tccaggccactactgaatac

SEQ ID NO: 10314 - DNA, 20 bp, Artificial Sequence
  Description of Artificial Sequence: Synthetic oligonucleotide
  Target: AGXT; (+) strand; PAM type: NRG; PAM sequence: AGG
ccaggccactactgaatacc

SEQ ID NO: 10315 - DNA, 20 bp, Artificial Sequence
  Description of Artificial Sequence: Synthetic oligonucleotide
  Target: AGXT; (+) strand; PAM type: NRG; PAM sequence: CAG
aaaatctgacccctcctcat

SEQ ID NO: 10316 - DNA, 20 bp, Artificial Sequence
  Description of Artificial Sequence: Synthetic oligonucleotide
  Target: AGXT; (+) strand; PAM type: NRG; PAM sequence: AAG
gacccctcctcatcagaact

SEQ ID NO: 10317 - DNA, 20 bp, Artificial Sequence
  Description of Artificial Sequence: Synthetic oligonucleotide
  Target: AGXT; (+) strand; PAM type: NRG; PAM sequence: TGG
actaagacctcctgttaacc

SEQ ID NO: 10318 - DNA, 20 bp, Artificial Sequence
  Description of Artificial Sequence: Synthetic oligonucleotide
  Target: AGXT; (+) strand; PAM type: NRG; PAM sequence: GGG
ctaagacctcctgttaacct

SEQ ID NO: 10319 - DNA, 20 bp, Artificial Sequence
  Description of Artificial Sequence: Synthetic oligonucleotide
  Target: AGXT; (+) strand; PAM type: NRG; PAM sequence: GGG
taagacctcctgttaacctg

SEQ ID NO: 10320 - DNA, 20 bp, Artificial Sequence
  Description of Artificial Sequence: Synthetic oligonucleotide
  Target: AGXT; (+) strand; PAM type: NRG; PAM sequence: TGG
cctcctgttaacctggggac

SEQ ID NO: 10321 - DNA, 20 bp, Artificial Sequence
  Description of Artificial Sequence: Synthetic oligonucleotide
  Target: AGXT; (+) strand; PAM type: NRG; PAM sequence: GGG
ctcctgttaacctggggact

SEQ ID NO: 10322 - DNA, 20 bp, Artificial Sequence
  Description of Artificial Sequence: Synthetic oligonucleotide
  Target: AGXT; (+) strand; PAM type: NRG; PAM sequence: CAG
atatttaaaaactttgcctc

SEQ ID NO: 10323 - DNA, 20 bp, Artificial Sequence
  Description of Artificial Sequence: Synthetic oligonucleotide
  Target: AGXT; (+) strand; PAM type: NRG; PAM sequence: CAG
ttaaaaactttgcctccaga

SEQ ID NO: 10324 - DNA, 20 bp, Artificial Sequence
  Description of Artificial Sequence: Synthetic oligonucleotide
  Target: AGXT; (+) strand; PAM type: NRG; PAM sequence: CAG
tccagacagaaaaccccttc

SEQ ID NO: 10325 - DNA, 20 bp, Artificial Sequence
  Description of Artificial Sequence: Synthetic oligonucleotide
  Target: AGXT; (+) strand; PAM type: NRG; PAM sequence: TGG
gaaaaccccttccagccctc

SEQ ID NO: 10326 - DNA, 20 bp, Artificial Sequence
  Description of Artificial Sequence: Synthetic oligonucleotide
  Target: AGXT; (+) strand; PAM type: NRG; PAM sequence: TGG
ccccttccagccctctggac

SEQ ID NO: 10327 - DNA, 20 bp, Artificial Sequence
  Description of Artificial Sequence: Synthetic oligonucleotide
  Target: AGXT; (+) strand; PAM type: NRG; PAM sequence: AAG
cctctggactggaccctttc

SEQ ID NO: 10328 - DNA, 20 bp, Artificial Sequence
  Description of Artificial Sequence: Synthetic oligonucleotide
  Target: AGXT; (+) strand; PAM type: NRG; PAM sequence: TAG
tggaccctttcaagtcctca

SEQ ID NO: 10329 - DNA, 20 bp, Artificial Sequence
  Description of Artificial Sequence: Synthetic oligonucleotide
  Target: AGXT; (+) strand; PAM type: NRG; PAM sequence: CAG
agtcctcatagcctctccca

SEQ ID NO: 10330 - DNA, 20 bp, Artificial Sequence
  Description of Artificial Sequence: Synthetic oligonucleotide
  Target: AGXT; (+) strand; PAM type: NRG; PAM sequence: CAG
tctcccacagctgttaactg

SEQ ID NO: 10331 - DNA, 20 bp, Artificial Sequence
  Description of Artificial Sequence: Synthetic oligonucleotide
  Target: AGXT; (+) strand; PAM type: NRG; PAM sequence: AGG
ctcccacagctgttaactgc

SEQ ID NO: 10332 - DNA, 20 bp, Artificial Sequence
  Description of Artificial Sequence: Synthetic oligonucleotide
  Target: AGXT; (+) strand; PAM type: NRG; PAM sequence: GGG
tcccacagctgttaactgca

SEQ ID NO: 10333 - DNA, 20 bp, Artificial Sequence
  Description of Artificial Sequence: Synthetic oligonucleotide
  Target: AGXT; (+) strand; PAM type: NRG; PAM sequence: TGG
aactgcagggattctcccct

SEQ ID NO: 10334 - DNA, 20 bp, Artificial Sequence
  Description of Artificial Sequence: Synthetic oligonucleotide
  Target: AGXT; (+) strand; PAM type: NRG; PAM sequence: GGG
actgcagggattctcccctt

SEQ ID NO: 10335 - DNA, 20 bp, Artificial Sequence
  Description of Artificial Sequence: Synthetic oligonucleotide
  Target: AGXT; (+) strand; PAM type: NRG; PAM sequence: AAG
gggtccacctttgccacata

SEQ ID NO: 10336 - DNA, 20 bp, Artificial Sequence
  Description of Artificial Sequence: Synthetic oligonucleotide
  Target: AGXT; (+) strand; PAM type: NRG; PAM sequence: CAG
cataaagtctgtactgccgc

SEQ ID NO: 10337 - DNA, 20 bp, Artificial Sequence
  Description of Artificial Sequence: Synthetic oligonucleotide
  Target: AGXT; (+) strand; PAM type: NRG; PAM sequence: CAG
ctgtactgccgccagaactc

SEQ ID NO: 10338 - DNA, 20 bp, Artificial Sequence
  Description of Artificial Sequence: Synthetic oligonucleotide
  Target: AGXT; (+) strand; PAM type: NRG; PAM sequence: GAG
ctccagcctgcttacacttt

SEQ ID NO: 10339 - DNA, 20 bp, Artificial Sequence
  Description of Artificial Sequence: Synthetic oligonucleotide
  Target: AGXT; (+) strand; PAM type: NRG; PAM sequence: TGG
ctgcttacactttgagccct

SEQ ID NO: 10340 - DNA, 20 bp, Artificial Sequence
  Description of Artificial Sequence: Synthetic oligonucleotide
  Target: AGXT; (+) strand; PAM type: NRG; PAM sequence: AAG
cttacactttgagcccttgg

SEQ ID NO: 10341 - DNA, 20 bp, Artificial Sequence
  Description of Artificial Sequence: Synthetic oligonucleotide
  Target: AGXT; (+) strand; PAM type: NRG; PAM sequence: CAG
atttttgttttgcaaacaac

SEQ ID NO: 10342 - DNA, 20 bp, Artificial Sequence
  Description of Artificial Sequence: Synthetic oligonucleotide
  Target: AGXT; (+) strand; PAM type: NRG; PAM sequence: AGG
tttttgttttgcaaacaacc

SEQ ID NO: 10343 - DNA, 20 bp, Artificial Sequence
  Description of Artificial Sequence: Synthetic oligonucleotide
  Target: AGXT; (+) strand; PAM type: NRG; PAM sequence: AAG
tgacactaacctctcttcaa

SEQ ID NO: 10344 - DNA, 20 bp, Artificial Sequence
  Description of Artificial Sequence: Synthetic oligonucleotide
  Target: AGXT; (+) strand; PAM type: NRG; PAM sequence: AAG
ctaacctctcttcaaaagca

SEQ ID NO: 10345 - DNA, 20 bp, Artificial Sequence
  Description of Artificial Sequence: Synthetic oligonucleotide
  Target: AGXT; (+) strand; PAM type: NRG; PAM sequence: AGG
taacctctcttcaaaagcaa

SEQ ID NO: 10346 - DNA, 20 bp, Artificial Sequence
  Description of Artificial Sequence: Synthetic oligonucleotide
  Target: AGXT; (+) strand; PAM type: NRG; PAM sequence: AAG
aaaagcaaaggataccacgt

SEQ ID NO: 10347 - DNA, 20 bp, Artificial Sequence
  Description of Artificial Sequence: Synthetic oligonucleotide
  Target: AGXT; (+) strand; PAM type: NRG; PAM sequence: TAG
attcatttccttatgtactc

SEQ ID NO: 10348 - DNA, 20 bp, Artificial Sequence
  Description of Artificial Sequence: Synthetic oligonucleotide
  Target: AGXT; (+) strand; PAM type: NRG; PAM sequence: AAG
catttccttatgtactctag

SEQ ID NO: 10349 - DNA, 20 bp, Artificial Sequence
  Description of Artificial Sequence: Synthetic oligonucleotide
  Target: AGXT; (+) strand; PAM type: NRG; PAM sequence: TAG
atgtactctagaagcgtttt

SEQ ID NO: 10350 - DNA, 20 bp, Artificial Sequence
  Description of Artificial Sequence: Synthetic oligonucleotide
  Target: AGXT; (+) strand; PAM type: NRG; PAM sequence: AGG
tgtactctagaagcgttttt

SEQ ID NO: 10351 - DNA, 20 bp, Artificial Sequence
  Description of Artificial Sequence: Synthetic oligonucleotide
  Target: AGXT; (+) strand; PAM type: NRG; PAM sequence: GAG
tttaggtcctccaattttct

SEQ ID NO: 10352 - DNA, 20 bp, Artificial Sequence
  Description of Artificial Sequence: Synthetic oligonucleotide
  Target: AGXT; (+) strand; PAM type: NRG; PAM sequence: GAG
tttttttttttttttttttt

SEQ ID NO: 10353 - DNA, 20 bp, Artificial Sequence
  Description of Artificial Sequence: Synthetic oligonucleotide
  Target: AGXT; (+) strand; PAM type: NRG; PAM sequence: CAG
ttttttttttttttttgaga

SEQ ID NO: 10354 - DNA, 20 bp, Artificial Sequence
  Description of Artificial Sequence: Synthetic oligonucleotide
  Target: AGXT; (+) strand; PAM type: NRG; PAM sequence: GAG
ttttttttttttttgagaca

SEQ ID NO: 10355 - DNA, 20 bp, Artificial Sequence
  Description of Artificial Sequence: Synthetic oligonucleotide
  Target: AGXT; (+) strand; PAM type: NRG; PAM sequence: CAG
agagttttgctcttgtcacc

SEQ ID NO: 10356 - DNA, 20 bp, Artificial Sequence
  Description of Artificial Sequence: Synthetic oligonucleotide
  Target: AGXT; (+) strand; PAM type: NRG; PAM sequence: AGG
gagttttgctcttgtcaccc

SEQ ID NO: 10357 - DNA, 20 bp, Artificial Sequence
  Description of Artificial Sequence: Synthetic oligonucleotide
  Target: AGXT; (+) strand; PAM type: NRG; PAM sequence: TAG
tgctcttgtcacccaggcta

SEQ ID NO: 10358 - DNA, 20 bp, Artificial Sequence
  Description of Artificial Sequence: Synthetic oligonucleotide
  Target: AGXT; (+) strand; PAM type: NRG; PAM sequence: TGG
tcacccaggctatagtgcaa

SEQ ID NO: 10359 - DNA, 20 bp, Artificial Sequence
  Description of Artificial Sequence: Synthetic oligonucleotide
  Target: AGXT; (+) strand; PAM type: NRG; PAM sequence: CGG
atagtgcaatggtgcgatct

SEQ ID NO: 10360 - DNA, 20 bp, Artificial Sequence
  Description of Artificial Sequence: Synthetic oligonucleotide
  Target: AGXT; (+) strand; PAM type: NRG; PAM sequence: CGG
tcactgcaaccgccatctcc

SEQ ID NO: 10361 - DNA, 20 bp, Artificial Sequence
  Description of Artificial Sequence: Synthetic oligonucleotide
  Target: AGXT; (+) strand; PAM type: NRG; PAM sequence: GGG
cactgcaaccgccatctccc

SEQ ID NO: 10362 - DNA, 20 bp, Artificial Sequence
  Description of Artificial Sequence: Synthetic oligonucleotide
  Target: AGXT; (+) strand; PAM type: NRG; PAM sequence: AAG
aaccgccatctcccgggttc

SEQ ID NO: 10363 - DNA, 20 bp, Artificial Sequence
  Description of Artificial Sequence: Synthetic oligonucleotide
  Target: AGXT; (+) strand; PAM type: NRG; PAM sequence: GAG
ttctcccgcctcaacctcct

SEQ ID NO: 10364 - DNA, 20 bp, Artificial Sequence
  Description of Artificial Sequence: Synthetic oligonucleotide
  Target: AGXT; (+) strand; PAM type: NRG; PAM sequence: TAG
tcccgcctcaacctcctgag

SEQ ID NO: 10365 - DNA, 20 bp, Artificial Sequence
  Description of Artificial Sequence: Synthetic oligonucleotide
  Target: AGXT; (+) strand; PAM type: NRG; PAM sequence: TGG
gcctcaacctcctgagtagc

SEQ ID NO: 10366 - DNA, 20 bp, Artificial Sequence
  Description of Artificial Sequence: Synthetic oligonucleotide
  Target: AGXT; (+) strand; PAM type: NRG; PAM sequence: GGG
cctcaacctcctgagtagct

SEQ ID NO: 10367 - DNA, 20 bp, Artificial Sequence
  Description of Artificial Sequence: Synthetic oligonucleotide
  Target: AGXT; (+) strand; PAM type: NRG; PAM sequence: CAG
ctcctgagtagctgggatta

SEQ ID NO: 10368 - DNA, 20 bp, Artificial Sequence
  Description of Artificial Sequence: Synthetic oligonucleotide
  Target: AGXT; (+) strand; PAM type: NRG; PAM sequence: AGG
tcctgagtagctgggattac

SEQ ID NO: 10369 - DNA, 20 bp, Artificial Sequence
  Description of Artificial Sequence: Synthetic oligonucleotide
  Target: AGXT; (+) strand; PAM type: NRG; PAM sequence: CGG
caggcatgcaccaccatgcc

SEQ ID NO: 10370 - DNA, 20 bp, Artificial Sequence
  Description of Artificial Sequence: Synthetic oligonucleotide
  Target: AGXT; (+) strand; PAM type: NRG; PAM sequence: TAG
tttttttttttttgtatttt

SEQ ID NO: 10371 - DNA, 20 bp, Artificial Sequence
  Description of Artificial Sequence: Synthetic oligonucleotide
  Target: AGXT; (+) strand; PAM type: NRG; PAM sequence: TAG
ttttttttttgtatttttag

SEQ ID NO: 10372 - DNA, 20 bp, Artificial Sequence
  Description of Artificial Sequence: Synthetic oligonucleotide
  Target: AGXT; (+) strand; PAM type: NRG; PAM sequence: GAG
ttttttttgtatttttagta

SEQ ID NO: 10373 - DNA, 20 bp, Artificial Sequence
  Description of Artificial Sequence: Synthetic oligonucleotide
  Target: AGXT; (+) strand; PAM type: NRG; PAM sequence: CAG
ttttgtatttttagtagaga

SEQ ID NO: 10374 - DNA, 20 bp, Artificial Sequence
  Description of Artificial Sequence: Synthetic oligonucleotide
  Target: AGXT; (+) strand; PAM type: NRG; PAM sequence: AGG
tttgtatttttagtagagac

SEQ ID NO: 10375 - DNA, 20 bp, Artificial Sequence
  Description of Artificial Sequence: Synthetic oligonucleotide
  Target: AGXT; (+) strand; PAM type: NRG; PAM sequence: GGG
ttgtatttttagtagagaca

SEQ ID NO: 10376 - DNA, 20 bp, Artificial Sequence
  Description of Artificial Sequence: Synthetic oligonucleotide
  Target: AGXT; (+) strand; PAM type: NRG; PAM sequence: TGG
gagacagggtttcaccatgt

SEQ ID NO: 10377 - DNA, 20 bp, Artificial Sequence
  Description of Artificial Sequence: Synthetic oligonucleotide
  Target: AGXT; (+) strand; PAM type: NRG; PAM sequence: CAG
cagggtttcaccatgttggc

SEQ ID NO: 10378 - DNA, 20 bp, Artificial Sequence
  Description of Artificial Sequence: Synthetic oligonucleotide
  Target: AGXT; (+) strand; PAM type: NRG; PAM sequence: AGG
agggtttcaccatgttggcc

SEQ ID NO: 10379 - DNA, 20 bp, Artificial Sequence
  Description of Artificial Sequence: Synthetic oligonucleotide
  Target: AGXT; (+) strand; PAM type: NRG; PAM sequence: CAG
tgttctcacacttctgacct

SEQ ID NO: 10380 - DNA, 20 bp, Artificial Sequence
  Description of Artificial Sequence: Synthetic oligonucleotide
  Target: AGXT; (+) strand; PAM type: NRG; PAM sequence: AGG
gttctcacacttctgacctc

SEQ ID NO: 10381 - DNA, 20 bp, Artificial Sequence
  Description of Artificial Sequence: Synthetic oligonucleotide
  Target: AGXT; (+) strand; PAM type: NRG; PAM sequence: CAG
ctcaggtgatccgcccgtct

SEQ ID NO: 10382 - DNA, 20 bp, Artificial Sequence
  Description of Artificial Sequence: Synthetic oligonucleotide
  Target: AGXT; (+) strand; PAM type: NRG; PAM sequence: AAG
ccgcccgtctcagcctccca

SEQ ID NO: 10383 - DNA, 20 bp, Artificial Sequence
  Description of Artificial Sequence: Synthetic oligonucleotide
  Target: AGXT; (+) strand; PAM type: NRG; PAM sequence: TGG
gtctcagcctcccaaagtgc

SEQ ID NO: 10384 - DNA, 20 bp, Artificial Sequence
  Description of Artificial Sequence: Synthetic oligonucleotide
  Target: AGXT; (+) strand; PAM type: NRG; PAM sequence: CAG
ctcccaaagtgctggaatta

SEQ ID NO: 10385 - DNA, 20 bp, Artificial Sequence
  Description of Artificial Sequence: Synthetic oligonucleotide
  Target: AGXT; (+) strand; PAM type: NRG; PAM sequence: AGG
tcccaaagtgctggaattac

SEQ ID NO: 10386 - DNA, 20 bp, Artificial Sequence
  Description of Artificial Sequence: Synthetic oligonucleotide
  Target: AGXT; (+) strand; PAM type: NRG; PAM sequence: GAG
agtgctggaattacaggcat

SEQ ID NO: 10387 - DNA, 20 bp, Artificial Sequence
  Description of Artificial Sequence: Synthetic oligonucleotide
  Target: AGXT; (+) strand; PAM type: NRG; PAM sequence: CAG
caggcatgagccaccacacc

SEQ ID NO: 10388 - DNA, 20 bp, Artificial Sequence
  Description of Artificial Sequence: Synthetic oligonucleotide
  Target: AGXT; (+) strand; PAM type: NRG; PAM sequence: AAG
ttatccaatccccatttctc

SEQ ID NO: 10389 - DNA, 20 bp, Artificial Sequence
  Description of Artificial Sequence: Synthetic oligonucleotide
  Target: AGXT; (+) strand; PAM type: NRG; PAM sequence: CAG
aagacccacatacaattatt

SEQ ID NO: 10390 - DNA, 20 bp, Artificial Sequence
  Description of Artificial Sequence: Synthetic oligonucleotide
  Target: AGXT; (+) strand; PAM type: NRG; PAM sequence: TAG
tacaattattcagcttgcac

SEQ ID NO: 10391 - DNA, 20 bp, Artificial Sequence
  Description of Artificial Sequence: Synthetic oligonucleotide
  Target: AGXT; (+) strand; PAM type: NRG; PAM sequence: CAG
ttgcactagatttttatttg

SEQ ID NO: 10392 - DNA, 20 bp, Artificial Sequence
  Description of Artificial Sequence: Synthetic oligonucleotide
  Target: AGXT; (+) strand; PAM type: NRG; PAM sequence: AGG
tgcactagatttttatttgc

SEQ ID NO: 10393 - DNA, 20 bp, Artificial Sequence
  Description of Artificial Sequence: Synthetic oligonucleotide
  Target: AGXT; (+) strand; PAM type: NRG; PAM sequence: GGG
gcactagatttttatttgca

SEQ ID NO: 10394 - DNA, 20 bp, Artificial Sequence
  Description of Artificial Sequence: Synthetic oligonucleotide
  Target: AGXT; (+) strand; PAM type: NRG; PAM sequence: TGG
ctagatttttatttgcaggg

SEQ ID NO: 10395 - DNA, 20 bp, Artificial Sequence
  Description of Artificial Sequence: Synthetic oligonucleotide
  Target: AGXT; (+) strand; PAM type: NRG; PAM sequence: TGG
gtggtttttctaattatact

SEQ ID NO: 10396 - DNA, 20 bp, Artificial Sequence
  Description of Artificial Sequence: Synthetic oligonucleotide
  Target: AGXT; (+) strand; PAM type: NRG; PAM sequence: GAG
ggtttttctaattatacttg

SEQ ID NO: 10397 - DNA, 20 bp, Artificial Sequence
  Description of Artificial Sequence: Synthetic oligonucleotide
  Target: AGXT; (+) strand; PAM type: NRG; PAM sequence: CAG
acttggagcaacttttgtaa

SEQ ID NO: 10398 - DNA, 20 bp, Artificial Sequence
  Description of Artificial Sequence: Synthetic oligonucleotide
  Target: AGXT; (+) strand; PAM type: NRG; PAM sequence: TAG
ttttgtaacagtccttgaat

SEQ ID NO: 10399 - DNA, 20 bp, Artificial Sequence
  Description of Artificial Sequence: Synthetic oligonucleotide
  Target: AGXT; (+) strand; PAM type: NRG; PAM sequence: GAG
agtccttgaattagaacaat

SEQ ID NO: 10400 - DNA, 20 bp, Artificial Sequence
  Description of Artificial Sequence: Synthetic oligonucleotide
  Target: AGXT; (+) strand; PAM type: NRG; PAM sequence: TGG
taaaaacttcccaatcctct

SEQ ID NO: 10401 - DNA, 20 bp, Artificial Sequence
  Description of Artificial Sequence: Synthetic oligonucleotide
  Target: AGXT; (+) strand; PAM type: NRG; PAM sequence: CAG
tggtttgacaatatcatctt

SEQ ID NO: 10402 - DNA, 20 bp, Artificial Sequence
  Description of Artificial Sequence: Synthetic oligonucleotide
  Target: AGXT; (+) strand; PAM type: NRG; PAM sequence: GAG
agcatctcacatgctattgt

SEQ ID NO: 10403 - DNA, 20 bp, Artificial Sequence
  Description of Artificial Sequence: Synthetic oligonucleotide
  Target: AGXT; (+) strand; PAM type: NRG; PAM sequence: GAG
catctcacatgctattgtga

SEQ ID NO: 10404 - DNA, 20 bp, Artificial Sequence
  Description of Artificial Sequence: Synthetic oligonucleotide
  Target: AGXT; (+) strand; PAM type: NRG; PAM sequence: AGG
atctcacatgctattgtgag

SEQ ID NO: 10405 - DNA, 20 bp, Artificial Sequence
  Description of Artificial Sequence: Synthetic oligonucleotide
  Target: AGXT; (+) strand; PAM type: NRG; PAM sequence: GAG
ctcacatgctattgtgagag

SEQ ID NO: 10406 - DNA, 20 bp, Artificial Sequence
  Description of Artificial Sequence: Synthetic oligonucleotide
  Target: AGXT; (+) strand; PAM type: NRG; PAM sequence: TGG
agaggagaaaatactctgtg

SEQ ID NO: 10407 - DNA, 20 bp, Artificial Sequence
  Description of Artificial Sequence: Synthetic oligonucleotide
  Target: AGXT; (+) strand; PAM type: NRG; PAM sequence: TGG
gagaaaatactctgtgtggc

SEQ ID NO: 10408 - DNA, 20 bp, Artificial Sequence
  Description of Artificial Sequence: Synthetic oligonucleotide
  Target: AGXT; (+) strand; PAM type: NRG; PAM sequence: AAG
cgtccacaacctgctactcc

SEQ ID NO: 10409 - DNA, 20 bp, Artificial Sequence
  Description of Artificial Sequence: Synthetic oligonucleotide
  Target: AGXT; (+) strand; PAM type: NRG; PAM sequence: TAG
acctgctactccaagccatg

SEQ ID NO: 10410 - DNA, 20 bp, Artificial Sequence
  Description of Artificial Sequence: Synthetic oligonucleotide
  Target: AGXT; (+) strand; PAM type: NRG; PAM sequence: AAG
ccatgtagattcttcttcgt

SEQ ID NO: 10411 - DNA, 20 bp, Artificial Sequence
  Description of Artificial Sequence: Synthetic oligonucleotide
  Target: AGXT; (+) strand; PAM type: NRG; PAM sequence: TGG
ctccaatcaaactgtactgt

SEQ ID NO: 10412 - DNA, 20 bp, Artificial Sequence
  Description of Artificial Sequence: Synthetic oligonucleotide
  Target: AGXT; (+) strand; PAM type: NRG; PAM sequence: GGG
tccaatcaaactgtactgtt

SEQ ID NO: 10413 - DNA, 20 bp, Artificial Sequence
  Description of Artificial Sequence: Synthetic oligonucleotide
  Target: AGXT; (+) strand; PAM type: NRG; PAM sequence: TGG
ccgaccatttccttctgtgc

SEQ ID NO: 10414 - DNA, 20 bp, Artificial Sequence
  Description of Artificial Sequence: Synthetic oligonucleotide
  Target: AGXT; (+) strand; PAM type: NRG; PAM sequence: TGG
ttccttctgtgctggtaaat

SEQ ID NO: 10415 - DNA, 20 bp, Artificial Sequence
  Description of Artificial Sequence: Synthetic oligonucleotide
  Target: AGXT; (+) strand; PAM type: NRG; PAM sequence: TGG
cttaacttgtaatgttattt

SEQ ID NO: 10416 - DNA, 20 bp, Artificial Sequence
  Description of Artificial Sequence: Synthetic oligonucleotide
  Target: AGXT; (+) strand; PAM type: NRG; PAM sequence: GGG
ttaacttgtaatgttatttt

SEQ ID NO: 10417 - DNA, 20 bp, Artificial Sequence
  Description of Artificial Sequence: Synthetic oligonucleotide
  Target: AGXT; (+) strand; PAM type: NRG; PAM sequence: GAG
aacttgtaatgttattttgg

SEQ ID NO: 10418 - DNA, 20 bp, Artificial Sequence
  Description of Artificial Sequence: Synthetic oligonucleotide
  Target: AGXT; (+) strand; PAM type: NRG; PAM sequence: AGG
acttgtaatgttattttggg

SEQ ID NO: 10419 - DNA, 20 bp, Artificial Sequence
  Description of Artificial Sequence: Synthetic oligonucleotide
  Target: AGXT; (+) strand; PAM type: NRG; PAM sequence: CAG
ttgttataatgacactcatg

SEQ ID NO: 10420 - DNA, 20 bp, Artificial Sequence
  Description of Artificial Sequence: Synthetic oligonucleotide
  Target: AGXT; (+) strand; PAM type: NRG; PAM sequence: GAG
cagctaactttgactcattt

SEQ ID NO: 10421 - DNA, 20 bp, Artificial Sequence
  Description of Artificial Sequence: Synthetic oligonucleotide
  Target: AGXT; (+) strand; PAM type: NRG; PAM sequence: AGG
agctaactttgactcatttg

SEQ ID NO: 10422 - DNA, 20 bp, Artificial Sequence
  Description of Artificial Sequence: Synthetic oligonucleotide
  Target: AGXT; (+) strand; PAM type: NRG; PAM sequence: TGG
tacaatcaaaactctgactc

SEQ ID NO: 10423 - DNA, 20 bp, Artificial Sequence
  Description of Artificial Sequence: Synthetic oligonucleotide
  Target: AGXT; (+) strand; PAM type: NRG; PAM sequence: CAG
atcaaaactctgactctggc

SEQ ID NO: 10424 - DNA, 20 bp, Artificial Sequence
  Description of Artificial Sequence: Synthetic oligonucleotide
  Target: AGXT; (+) strand; PAM type: NRG; PAM sequence: AGG
tcaaaactctgactctggcc

SEQ ID NO: 10425 - DNA, 20 bp, Artificial Sequence
  Description of Artificial Sequence: Synthetic oligonucleotide
  Target: AGXT; (+) strand; PAM type: NRG; PAM sequence: TGG
ctgactctggccaggtgcgc

SEQ ID NO: 10426 - DNA, 20 bp, Artificial Sequence
  Description of Artificial Sequence: Synthetic oligonucleotide
  Target: AGXT; (+) strand; PAM type: NRG; PAM sequence: TGG
cacctgtaatcctaacactt

SEQ ID NO: 10427 - DNA, 20 bp, Artificial Sequence
  Description of Artificial Sequence: Synthetic oligonucleotide
  Target: AGXT; (+) strand; PAM type: NRG; PAM sequence: GGG
acctgtaatcctaacacttt

SEQ ID NO: 10428 - DNA, 20 bp, Artificial Sequence
  Description of Artificial Sequence: Synthetic oligonucleotide
  Target: AGXT; (+) strand; PAM type: NRG; PAM sequence: GAG
ctgtaatcctaacactttgg

SEQ ID NO: 10429 - DNA, 20 bp, Artificial Sequence
  Description of Artificial Sequence: Synthetic oligonucleotide
  Target: AGXT; (+) strand; PAM type: NRG; PAM sequence: AGG
tgtaatcctaacactttggg

SEQ ID NO: 10430 - DNA, 20 bp, Artificial Sequence
  Description of Artificial Sequence: Synthetic oligonucleotide
  Target: AGXT; (+) strand; PAM type: NRG; PAM sequence: TAG
aatcctaacactttgggagg

SEQ ID NO: 10431 - DNA, 20 bp, Artificial Sequence
  Description of Artificial Sequence: Synthetic oligonucleotide
  Target: AGXT; (+) strand; PAM type: NRG; PAM sequence: GAG
tcctaacactttgggaggta

SEQ ID NO: 10432 - DNA, 20 bp, Artificial Sequence
  Description of Artificial Sequence: Synthetic oligonucleotide
  Target: AGXT; (+) strand; PAM type: NRG; PAM sequence: AGG
cctaacactttgggaggtag

SEQ ID NO: 10433 - DNA, 20 bp, Artificial Sequence
  Description of Artificial Sequence: Synthetic oligonucleotide
  Target: AGXT; (+) strand; PAM type: NRG; PAM sequence: TGG
aacactttgggaggtagagg

SEQ ID NO: 10434 - DNA, 20 bp, Artificial Sequence
  Description of Artificial Sequence: Synthetic oligonucleotide
  Target: AGXT; (+) strand; PAM type: NRG; PAM sequence: GGG
acactttgggaggtagaggt

SEQ ID NO: 10435 - DNA, 20 bp, Artificial Sequence
  Description of Artificial Sequence: Synthetic oligonucleotide
  Target: AGXT; (+) strand; PAM type: NRG; PAM sequence: TGG
ctttgggaggtagaggtggg

SEQ ID NO: 10436 - DNA, 20 bp, Artificial Sequence
  Description of Artificial Sequence: Synthetic oligonucleotide
  Target: AGXT; (+) strand; PAM type: NRG; PAM sequence: GAG
tagaggtgggtggatcacct

SEQ ID NO: 10437 - DNA, 20 bp, Artificial Sequence
  Description of Artificial Sequence: Synthetic oligonucleotide
  Target: AGXT; (+) strand; PAM type: NRG; PAM sequence: AGG
agaggtgggtggatcacctg

SEQ ID NO: 10438 - DNA, 20 bp, Artificial Sequence
  Description of Artificial Sequence: Synthetic oligonucleotide
  Target: AGXT; (+) strand; PAM type: NRG; PAM sequence: CAG
gtgggtggatcacctgaggt

SEQ ID NO: 10439 - DNA, 20 bp, Artificial Sequence
  Description of Artificial Sequence: Synthetic oligonucleotide
  Target: AGXT; (+) strand; PAM type: NRG; PAM sequence: AGG
tgggtggatcacctgaggtc

SEQ ID NO: 10440 - DNA, 20 bp, Artificial Sequence
  Description of Artificial Sequence: Synthetic oligonucleotide
  Target: AGXT; (+) strand; PAM type: NRG; PAM sequence: GAG
ggtggatcacctgaggtcag

SEQ ID NO: 10441 - DNA, 20 bp, Artificial Sequence
  Description of Artificial Sequence: Synthetic oligonucleotide
  Target: AGXT; (+) strand; PAM type: NRG; PAM sequence: GAG
tcacctgaggtcaggagttc

SEQ ID NO: 10442 - DNA, 20 bp, Artificial Sequence
  Description of Artificial Sequence: Synthetic oligonucleotide
  Target: AGXT; (+) strand; PAM type: NRG; PAM sequence: CAG
tgaggtcaggagttcgagac

SEQ ID NO: 10443 - DNA, 20 bp, Artificial Sequence
  Description of Artificial Sequence: Synthetic oligonucleotide
  Target: AGXT; (+) strand; PAM type: NRG; PAM sequence: TGG
cgagaccagtctgaccaaca

SEQ ID NO: 10444 - DNA, 20 bp, Artificial Sequence
  Description of Artificial Sequence: Synthetic oligonucleotide
  Target: AGXT; (+) strand; PAM type: NRG; PAM sequence: TAG
tctactaaaaatacaaaaat

SEQ ID NO: 10445 - DNA, 20 bp, Artificial Sequence
  Description of Artificial Sequence: Synthetic oligonucleotide
  Target: AGXT; (+) strand; PAM type: NRG; PAM sequence: CAG
actaaaaatacaaaaattag

SEQ ID NO: 10446 - DNA, 20 bp, Artificial Sequence
  Description of Artificial Sequence: Synthetic oligonucleotide
  Target: AGXT; (+) strand; PAM type: NRG; PAM sequence: AGG
ctaaaaatacaaaaattagc

SEQ ID NO: 10447 - DNA, 20 bp, Artificial Sequence
  Description of Artificial Sequence: Synthetic oligonucleotide
  Target: AGXT; (+) strand; PAM type: NRG; PAM sequence: GGG
taaaaatacaaaaattagca

SEQ ID NO: 10448 - DNA, 20 bp, Artificial Sequence
  Description of Artificial Sequence: Synthetic oligonucleotide
  Target: AGXT; (+) strand; PAM type: NRG; PAM sequence: TGG
atacaaaaattagcagggcg

SEQ ID NO: 10449 - DNA, 20 bp, Artificial Sequence
  Description of Artificial Sequence: Synthetic oligonucleotide
  Target: AGXT; (+) strand; PAM type: NRG; PAM sequence: TGG
caaaaattagcagggcgtgg

SEQ ID NO: 10450 - DNA, 20 bp, Artificial Sequence
  Description of Artificial Sequence: Synthetic oligonucleotide
  Target: AGXT; (+) strand; PAM type: NRG; PAM sequence: CAG
aaattagcagggcgtggtgg

SEQ ID NO: 10451 - DNA, 20 bp, Artificial Sequence
  Description of Artificial Sequence: Synthetic oligonucleotide
  Target: AGXT; (+) strand; PAM type: NRG; PAM sequence: AGG
aattagcagggcgtggtggc

SEQ ID NO: 10452 - DNA, 20 bp, Artificial Sequence
  Description of Artificial Sequence: Synthetic oligonucleotide
  Target: AGXT; (+) strand; PAM type: NRG; PAM sequence: CAG
gtggcaggtgcctgtaatcc

SEQ ID NO: 10453 - DNA, 20 bp, Artificial Sequence
  Description of Artificial Sequence: Synthetic oligonucleotide
  Target: AGXT; (+) strand; PAM type: NRG; PAM sequence: CAG
tgcctgtaatcccagctact

SEQ ID NO: 10454 - DNA, 20 bp, Artificial Sequence
  Description of Artificial Sequence: Synthetic oligonucleotide
  Target: AGXT; (+) strand; PAM type: NRG; PAM sequence: AGG
gcctgtaatcccagctactc

SEQ ID NO: 10455 - DNA, 20 bp, Artificial Sequence
  Description of Artificial Sequence: Synthetic oligonucleotide
  Target: AGXT; (+) strand; PAM type: NRG; PAM sequence: GAG
ctgtaatcccagctactcag

SEQ ID NO: 10456 - DNA, 20 bp, Artificial Sequence
  Description of Artificial Sequence: Synthetic oligonucleotide
  Target: AGXT; (+) strand; PAM type: NRG; PAM sequence: AGG
tgtaatcccagctactcagg

SEQ ID NO: 10457 - DNA, 20 bp, Artificial Sequence
  Description of Artificial Sequence: Synthetic oligonucleotide
  Target: AGXT; (+) strand; PAM type: NRG; PAM sequence: GAG
tcccagctactcaggaggct

SEQ ID NO: 10458 - DNA, 20 bp, Artificial Sequence
  Description of Artificial Sequence: Synthetic oligonucleotide
  Target: AGXT; (+) strand; PAM type: NRG; PAM sequence: AGG
cccagctactcaggaggctg

SEQ ID NO: 10459 - DNA, 20 bp, Artificial Sequence
  Description of Artificial Sequence: Synthetic oligonucleotide
  Target: AGXT; (+) strand; PAM type: NRG; PAM sequence: CAG
agctactcaggaggctgagg

SEQ ID NO: 10460 - DNA, 20 bp, Artificial Sequence
  Description of Artificial Sequence: Synthetic oligonucleotide
  Target: AGXT; (+) strand; PAM type: NRG; PAM sequence: AGG
gctactcaggaggctgaggc

SEQ ID NO: 10461 - DNA, 20 bp, Artificial Sequence
  Description of Artificial Sequence: Synthetic oligonucleotide
  Target: AGXT; (+) strand; PAM type: NRG; PAM sequence: GAG
tactcaggaggctgaggcag

SEQ ID NO: 10462 - DNA, 20 bp, Artificial Sequence
  Description of Artificial Sequence: Synthetic oligonucleotide
  Target: AGXT; (+) strand; PAM type: NRG; PAM sequence: CAG
gcaggagaatcgcttgaacc

SEQ ID NO: 10463 - DNA, 20 bp, Artificial Sequence
  Description of Artificial Sequence: Synthetic oligonucleotide
  Target: AGXT; (+) strand; PAM type: NRG; PAM sequence: AGG
caggagaatcgcttgaaccc

SEQ ID NO: 10464 - DNA, 20 bp, Artificial Sequence
  Description of Artificial Sequence: Synthetic oligonucleotide
  Target: AGXT; (+) strand; PAM type: NRG; PAM sequence: GAG
ggagaatcgcttgaacccag

SEQ ID NO: 10465 - DNA, 20 bp, Artificial Sequence
  Description of Artificial Sequence: Synthetic oligonucleotide
  Target: AGXT; (+) strand; PAM type: NRG; PAM sequence: CAG
gaatcgcttgaacccaggag

SEQ ID NO: 10466 - DNA, 20 bp, Artificial Sequence
  Description of Artificial Sequence: Synthetic oligonucleotide
  Target: AGXT; (+) strand; PAM type: NRG; PAM sequence: GAG
atcgcttgaacccaggagca

SEQ ID NO: 10467 - DNA, 20 bp, Artificial Sequence
  Description of Artificial Sequence: Synthetic oligonucleotide
  Target: AGXT; (+) strand; PAM type: NRG; PAM sequence: AGG
tcgcttgaacccaggagcag

SEQ ID NO: 10468 - DNA, 20 bp, Artificial Sequence
  Description of Artificial Sequence: Synthetic oligonucleotide
  Target: AGXT; (+) strand; PAM type: NRG; PAM sequence: CAG
gaacccaggagcagaggttg

SEQ ID NO: 10469 - DNA, 20 bp, Artificial Sequence
  Description of Artificial Sequence: Synthetic oligonucleotide
  Target: AGXT; (+) strand; PAM type: NRG; PAM sequence: GAG
ccaggagcagaggttgcagt

SEQ ID NO: 10470 - DNA, 20 bp, Artificial Sequence
  Description of Artificial Sequence: Synthetic oligonucleotide
  Target: AGXT; (+) strand; PAM type: NRG; PAM sequence: AAG
agcagaggttgcagtgagcc

SEQ ID NO: 10471 - DNA, 20 bp, Artificial Sequence
  Description of Artificial Sequence: Synthetic oligonucleotide
  Target: AGXT; (+) strand; PAM type: NRG; PAM sequence: AGG
gcagaggttgcagtgagcca

SEQ ID NO: 10472 - DNA, 20 bp, Artificial Sequence
  Description of Artificial Sequence: Synthetic oligonucleotide
  Target: AGXT; (+) strand; PAM type: NRG; PAM sequence: CAG
aaggtcacaccacttcactc

SEQ ID NO: 10473 - DNA, 20 bp, Artificial Sequence
  Description of Artificial Sequence: Synthetic oligonucleotide
  Target: AGXT; (+) strand; PAM type: NRG; PAM sequence: TGG
cacaccacttcactccagcc

SEQ ID NO: 10474 - DNA, 20 bp, Artificial Sequence
  Description of Artificial Sequence: Synthetic oligonucleotide
  Target: AGXT; (+) strand; PAM type: NRG; PAM sequence: GGG
acaccacttcactccagcct

SEQ ID NO: 10475 - DNA, 20 bp, Artificial Sequence
  Description of Artificial Sequence: Synthetic oligonucleotide
  Target: AGXT; (+) strand; PAM type: NRG; PAM sequence: GAG
tcactccagcctgggcaact

SEQ ID NO: 10476 - DNA, 20 bp, Artificial Sequence
  Description of Artificial Sequence: Synthetic oligonucleotide
  Target: AGXT; (+) strand; PAM type: NRG; PAM sequence: GAG
tccagcctgggcaactgagt

SEQ ID NO: 10477 - DNA, 20 bp, Artificial Sequence
  Description of Artificial Sequence: Synthetic oligonucleotide
  Target: AGXT; (+) strand; PAM type: NRG; PAM sequence: AAG
tctcatcactgccaatttat

SEQ ID NO: 10478 - DNA, 20 bp, Artificial Sequence
  Description of Artificial Sequence: Synthetic oligonucleotide
  Target: AGXT; (+) strand; PAM type: NRG; PAM sequence: TGG
caatttataagccgttaaac

SEQ ID NO: 10479 - DNA, 20 bp, Artificial Sequence
  Description of Artificial Sequence: Synthetic oligonucleotide
  Target: AGXT; (+) strand; PAM type: NRG; PAM sequence: CAG
tataagccgttaaactggac

SEQ ID NO: 10480 - DNA, 20 bp, Artificial Sequence
  Description of Artificial Sequence: Synthetic oligonucleotide
  Target: AGXT; (+) strand; PAM type: NRG; PAM sequence: TAG
gccgttaaactggaccagta

SEQ ID NO: 10481 - DNA, 20 bp, Artificial Sequence
  Description of Artificial Sequence: Synthetic oligonucleotide
  Target: AGXT; (+) strand; PAM type: NRG; PAM sequence: TGG
gttaaactggaccagtatag

SEQ ID NO: 10482 - DNA, 20 bp, Artificial Sequence
  Description of Artificial Sequence: Synthetic oligonucleotide
  Target: AGXT; (+) strand; PAM type: NRG; PAM sequence: GGG
ttaaactggaccagtatagt

SEQ ID NO: 10483 - DNA, 20 bp, Artificial Sequence
  Description of Artificial Sequence: Synthetic oligonucleotide
  Target: AGXT; (+) strand; PAM type: NRG; PAM sequence: GGG
taaactggaccagtatagtg

SEQ ID NO: 10484 - DNA, 20 bp, Artificial Sequence
  Description of Artificial Sequence: Synthetic oligonucleotide
  Target: AGXT; (+) strand; PAM type: NRG; PAM sequence: CAG
gaccagtatagtggggctcc

SEQ ID NO: 10485 - DNA, 20 bp, Artificial Sequence
  Description of Artificial Sequence: Synthetic oligonucleotide
  Target: AGXT; (+) strand; PAM type: NRG; PAM sequence: CAG
atagtggggctcccagtata

SEQ ID NO: 10486 - DNA, 20 bp, Artificial Sequence
  Description of Artificial Sequence: Synthetic oligonucleotide
  Target: AGXT; (+) strand; PAM type: NRG; PAM sequence: CAG
tgttactataatgatgcaac

SEQ ID NO: 10487 - DNA, 20 bp, Artificial Sequence
  Description of Artificial Sequence: Synthetic oligonucleotide
  Target: AGXT; (+) strand; PAM type: NRG; PAM sequence: CAG
ctataatgatgcaaccagtg

SEQ ID NO: 10488 - DNA, 20 bp, Artificial Sequence
  Description of Artificial Sequence: Synthetic oligonucleotide
  Target: AGXT; (+) strand; PAM type: NRG; PAM sequence: AGG
tataatgatgcaaccagtgc

SEQ ID NO: 10489 - DNA, 20 bp, Artificial Sequence
  Description of Artificial Sequence: Synthetic oligonucleotide
  Target: AGXT; (+) strand; PAM type: NRG; PAM sequence: TGG
gaaataaccaccgtgccacc

SEQ ID NO: 10490 - DNA, 20 bp, Artificial Sequence
  Description of Artificial Sequence: Synthetic oligonucleotide
  Target: AGXT; (+) strand; PAM type: NRG; PAM sequence: TGG
ttacatcctatgccatgcac

SEQ ID NO: 10491 - DNA, 20 bp, Artificial Sequence
  Description of Artificial Sequence: Synthetic oligonucleotide
  Target: AGXT; (+) strand; PAM type: NRG; PAM sequence: CAG
tgcttttaaacctcctccat

SEQ ID NO: 10492 - DNA, 20 bp, Artificial Sequence
  Description of Artificial Sequence: Synthetic oligonucleotide
  Target: AGXT; (+) strand; PAM type: NRG; PAM sequence: TAG
cctccatcagtacataaaca

SEQ ID NO: 10493 - DNA, 20 bp, Artificial Sequence
  Description of Artificial Sequence: Synthetic oligonucleotide
  Target: AGXT; (+) strand; PAM type: NRG; PAM sequence: GAG
acatagtctttcccccatat

SEQ ID NO: 10494 - DNA, 20 bp, Artificial Sequence
  Description of Artificial Sequence: Synthetic oligonucleotide
  Target: AGXT; (+) strand; PAM type: NRG; PAM sequence: AAG
agtcctcttaaaactgtcaa

SEQ ID NO: 10495 - DNA, 20 bp, Artificial Sequence
  Description of Artificial Sequence: Synthetic oligonucleotide
  Target: AGXT; (+) strand; PAM type: NRG; PAM sequence: AGG
gtcctcttaaaactgtcaaa

SEQ ID NO: 10496 - DNA, 20 bp, Artificial Sequence
  Description of Artificial Sequence: Synthetic oligonucleotide
  Target: AGXT; (+) strand; PAM type: NRG; PAM sequence: TGG
aataatcatcctgcccctcc

SEQ ID NO: 10497 - DNA, 20 bp, Artificial Sequence
  Description of Artificial Sequence: Synthetic oligonucleotide
  Target: AGXT; (+) strand; PAM type: NRG; PAM sequence: GGG
ataatcatcctgcccctcct

SEQ ID NO: 10498 - DNA, 20 bp, Artificial Sequence
  Description of Artificial Sequence: Synthetic oligonucleotide
  Target: AGXT; (+) strand; PAM type: NRG; PAM sequence: TGG
ctgcccctcctgggctctta

SEQ ID NO: 10499 - DNA, 20 bp, Artificial Sequence
  Description of Artificial Sequence: Synthetic oligonucleotide
  Target: AGXT; (+) strand; PAM type: NRG; PAM sequence: TAG
cctcctgggctcttatggct

SEQ ID NO: 10500 - DNA, 20 bp, Artificial Sequence
  Description of Artificial Sequence: Synthetic oligonucleotide
  Target: AGXT; (+) strand; PAM type: NRG; PAM sequence: CAG
cctgggctcttatggcttag

SEQ ID NO: 10501 - DNA, 20 bp, Artificial Sequence
  Description of Artificial Sequence: Synthetic oligonucleotide
  Target: AGXT; (+) strand; PAM type: NRG; PAM sequence: AAG
aaactatttaaacccttttc

SEQ ID NO: 10502 - DNA, 20 bp, Artificial Sequence
  Description of Artificial Sequence: Synthetic oligonucleotide
  Target: AGXT; (+) strand; PAM type: NRG; PAM sequence: TGG
tttaaacccttttcaagctt

SEQ ID NO: 10503 - DNA, 20 bp, Artificial Sequence
  Description of Artificial Sequence: Synthetic oligonucleotide
  Target: AGXT; (+) strand; PAM type: NRG; PAM sequence: TGG
cttgatcattctcttcacta

SEQ ID NO: 10504 - DNA, 20 bp, Artificial Sequence
  Description of Artificial Sequence: Synthetic oligonucleotide
  Target: AGXT; (+) strand; PAM type: NRG; PAM sequence: TAG
tctcttcactatggtgattg

SEQ ID NO: 10505 - DNA, 20 bp, Artificial Sequence
  Description of Artificial Sequence: Synthetic oligonucleotide
  Target: AGXT; (+) strand; PAM type: NRG; PAM sequence: TGG
tcactatggtgattgtagcc

SEQ ID NO: 10506 - DNA, 20 bp, Artificial Sequence
  Description of Artificial Sequence: Synthetic oligonucleotide
  Target: AGXT; (+) strand; PAM type: NRG; PAM sequence: GGG
cactatggtgattgtagcct

SEQ ID NO: 10507 - DNA, 20 bp, Artificial Sequence
  Description of Artificial Sequence: Synthetic oligonucleotide
  Target: AGXT; (+) strand; PAM type: NRG; PAM sequence: TAG
tgattgtagcctgggaacaa

SEQ ID NO: 10508 - DNA, 20 bp, Artificial Sequence
  Description of Artificial Sequence: Synthetic oligonucleotide
  Target: AGXT; (+) strand; PAM type: NRG; PAM sequence: CAG
cttaaacatcacttctaatt

SEQ ID NO: 10509 - DNA, 20 bp, Artificial Sequence
  Description of Artificial Sequence: Synthetic oligonucleotide
  Target: AGXT; (+) strand; PAM type: NRG; PAM sequence: TAG
tctaattcagaattcccttc

SEQ ID NO: 10510 - DNA, 20 bp, Artificial Sequence
  Description of Artificial Sequence: Synthetic oligonucleotide
  Target: AGXT; (+) strand; PAM type: NRG; PAM sequence: AAG
aattcagaattcccttctag

SEQ ID NO: 10511 - DNA, 20 bp, Artificial Sequence
  Description of Artificial Sequence: Synthetic oligonucleotide
  Target: AGXT; (+) strand; PAM type: NRG; PAM sequence: AGG
attcagaattcccttctaga

SEQ ID NO: 10512 - DNA, 20 bp, Artificial Sequence
  Description of Artificial Sequence: Synthetic oligonucleotide
  Target: AGXT; (+) strand; PAM type: NRG; PAM sequence: AAG
gaattcccttctagaaggaa

SEQ ID NO: 10513 - DNA, 20 bp, Artificial Sequence
  Description of Artificial Sequence: Synthetic oligonucleotide
  Target: AGXT; (+) strand; PAM type: NRG; PAM sequence: AGG
aattcccttctagaaggaaa

SEQ ID NO: 10514 - DNA, 20 bp, Artificial Sequence
  Description of Artificial Sequence: Synthetic oligonucleotide
  Target: AGXT; (+) strand; PAM type: NRG; PAM sequence: GGG
attcccttctagaaggaaaa

SEQ ID NO: 10515 - DNA, 20 bp, Artificial Sequence
  Description of Artificial Sequence: Synthetic oligonucleotide
  Target: AGXT; (+) strand; PAM type: NRG; PAM sequence: TGG
ttctagaaggaaaagggccc

SEQ ID NO: 10516 - DNA, 20 bp, Artificial Sequence
  Description of Artificial Sequence: Synthetic oligonucleotide
  Target: AGXT; (+) strand; PAM type: NRG; PAM sequence: GGG
tctagaaggaaaagggccct

SEQ ID NO: 10517 - DNA, 20 bp, Artificial Sequence
  Description of Artificial Sequence: Synthetic oligonucleotide
  Target: AGXT; (+) strand; PAM type: NRG; PAM sequence: TGG
aagggccctgggacttactg

SEQ ID NO: 10518 - DNA, 20 bp, Artificial Sequence
  Description of Artificial Sequence: Synthetic oligonucleotide
  Target: AGXT; (+) strand; PAM type: NRG; PAM sequence: CGG
gccctgggacttactgtggc

SEQ ID NO: 10519 - DNA, 20 bp, Artificial Sequence
  Description of Artificial Sequence: Synthetic oligonucleotide
  Target: AGXT; (+) strand; PAM type: NRG; PAM sequence: GAG
cctgggacttactgtggccg

SEQ ID NO: 10520 - DNA, 20 bp, Artificial Sequence
  Description of Artificial Sequence: Synthetic oligonucleotide
  Target: AGXT; (+) strand; PAM type: NRG; PAM sequence: TGG
acttactgtggccggagttg

SEQ ID NO: 10521 - DNA, 20 bp, Artificial Sequence
  Description of Artificial Sequence: Synthetic oligonucleotide
  Target: AGXT; (+) strand; PAM type: NRG; PAM sequence: GGG
cttactgtggccggagttgt

SEQ ID NO: 10522 - DNA, 20 bp, Artificial Sequence
  Description of Artificial Sequence: Synthetic oligonucleotide
  Target: AGXT; (+) strand; PAM type: NRG; PAM sequence: TGG
ctatcacaactcttacccct

SEQ ID NO: 10523 - DNA, 20 bp, Artificial Sequence
  Description of Artificial Sequence: Synthetic oligonucleotide
  Target: AGXT; (+) strand; PAM type: NRG; PAM sequence: GGG
tatcacaactcttacccctt

SEQ ID NO: 10524 - DNA, 20 bp, Artificial Sequence
  Description of Artificial Sequence: Synthetic oligonucleotide
  Target: AGXT; (+) strand; PAM type: NRG; PAM sequence: GGG
atcacaactcttaccccttg

SEQ ID NO: 10525 - DNA, 20 bp, Artificial Sequence
  Description of Artificial Sequence: Synthetic oligonucleotide
  Target: AGXT; (+) strand; PAM type: NRG; PAM sequence: GAG
cacaactcttaccccttggg

SEQ ID NO: 10526 - DNA, 20 bp, Artificial Sequence
  Description of Artificial Sequence: Synthetic oligonucleotide
  Target: AGXT; (+) strand; PAM type: NRG; PAM sequence: AGG
acaactcttaccccttgggg

SEQ ID NO: 10527 - DNA, 20 bp, Artificial Sequence
  Description of Artificial Sequence: Synthetic oligonucleotide
  Target: AGXT; (+) strand; PAM type: NRG; PAM sequence: CAG
cttggggaggttttacttac

SEQ ID NO: 10528 - DNA, 20 bp, Artificial Sequence
  Description of Artificial Sequence: Synthetic oligonucleotide
  Target: AGXT; (+) strand; PAM type: NRG; PAM sequence: AGG
ttggggaggttttacttacc

SEQ ID NO: 10529 - DNA, 20 bp, Artificial Sequence
  Description of Artificial Sequence: Synthetic oligonucleotide
  Target: AGXT; (+) strand; PAM type: NRG; PAM sequence: AAG
tttacttaccaggaaatcac

SEQ ID NO: 10530 - DNA, 20 bp, Artificial Sequence
  Description of Artificial Sequence: Synthetic oligonucleotide
  Target: AGXT; (+) strand; PAM type: NRG; PAM sequence: AAG
cttaccaggaaatcacaagt

SEQ ID NO: 10531 - DNA, 20 bp, Artificial Sequence
  Description of Artificial Sequence: Synthetic oligonucleotide
  Target: AGXT; (+) strand; PAM type: NRG; PAM sequence: GAG
taccaggaaatcacaagtaa

SEQ ID NO: 10532 - DNA, 20 bp, Artificial Sequence
  Description of Artificial Sequence: Synthetic oligonucleotide
  Target: AGXT; (+) strand; PAM type: NRG; PAM sequence: TAG
acctaccgcctcccttgaaa

SEQ ID NO: 10533 - DNA, 20 bp, Artificial Sequence
  Description of Artificial Sequence: Synthetic oligonucleotide
  Target: AGXT; (+) strand; PAM type: NRG; PAM sequence: AAG
cgcctcccttgaaatagcaa

SEQ ID NO: 10534 - DNA, 20 bp, Artificial Sequence
  Description of Artificial Sequence: Synthetic oligonucleotide
  Target: AGXT; (+) strand; PAM type: NRG; PAM sequence: TGG
tcccttgaaatagcaaaagc

SEQ ID NO: 10535 - DNA, 20 bp, Artificial Sequence
  Description of Artificial Sequence: Synthetic oligonucleotide
  Target: AGXT; (+) strand; PAM type: NRG; PAM sequence: CAG
aaaagctggcacccatctat

SEQ ID NO: 10536 - DNA, 20 bp, Artificial Sequence
  Description of Artificial Sequence: Synthetic oligonucleotide
  Target: AGXT; (+) strand; PAM type: NRG; PAM sequence: AAG
cacccatctatcagctctac

SEQ ID NO: 10537 - DNA, 20 bp, Artificial Sequence
  Description of Artificial Sequence: Synthetic oligonucleotide
  Target: AGXT; (+) strand; PAM type: NRG; PAM sequence: TAG
ctatcagctctacaagtcat

SEQ ID NO: 10538 - DNA, 20 bp, Artificial Sequence
  Description of Artificial Sequence: Synthetic oligonucleotide
  Target: AGXT; (+) strand; PAM type: NRG; PAM sequence: AAG
ctacaagtcattagactcac

SEQ ID NO: 10539 - DNA, 20 bp, Artificial Sequence
  Description of Artificial Sequence: Synthetic oligonucleotide
  Target: AGXT; (+) strand; PAM type: NRG; PAM sequence: CAG
caagtcattagactcacaag

SEQ ID NO: 10540 - DNA, 20 bp, Artificial Sequence
  Description of Artificial Sequence: Synthetic oligonucleotide
  Target: AGXT; (+) strand; PAM type: NRG; PAM sequence: AGG
aagtcattagactcacaagc

SEQ ID NO: 10541 - DNA, 20 bp, Artificial Sequence
  Description of Artificial Sequence: Synthetic oligonucleotide
  Target: AGXT; (+) strand; PAM type: NRG; PAM sequence: TGG
tagactcacaagcaggattt

SEQ ID NO: 10542 - DNA, 20 bp, Artificial Sequence
  Description of Artificial Sequence: Synthetic oligonucleotide
  Target: AGXT; (+) strand; PAM type: NRG; PAM sequence: TGG
acaagcaggattttggtgtc

SEQ ID NO: 10543 - DNA, 20 bp, Artificial Sequence
  Description of Artificial Sequence: Synthetic oligonucleotide
  Target: AGXT; (+) strand; PAM type: NRG; PAM sequence: CAG
aggattttggtgtctggtaa

SEQ ID NO: 10544 - DNA, 20 bp, Artificial Sequence
  Description of Artificial Sequence: Synthetic oligonucleotide
  Target: AGXT; (+) strand; PAM type: NRG; PAM sequence: AGG
ggattttggtgtctggtaac

SEQ ID NO: 10545 - DNA, 20 bp, Artificial Sequence
  Description of Artificial Sequence: Synthetic oligonucleotide
  Target: AGXT; (+) strand; PAM type: NRG; PAM sequence: GAG
tttggtgtctggtaacaggt

SEQ ID NO: 10546 - DNA, 20 bp, Artificial Sequence
  Description of Artificial Sequence: Synthetic oligonucleotide
  Target: AGXT; (+) strand; PAM type: NRG; PAM sequence: TGG
gtctggtaacaggtgagttc

SEQ ID NO: 10547 - DNA, 20 bp, Artificial Sequence
  Description of Artificial Sequence: Synthetic oligonucleotide
  Target: AGXT; (+) strand; PAM type: NRG; PAM sequence: TAG
gtgagttctggattacctcc

SEQ ID NO: 10548 - DNA, 20 bp, Artificial Sequence
  Description of Artificial Sequence: Synthetic oligonucleotide
  Target: AGXT; (+) strand; PAM type: NRG; PAM sequence: AAG
ggattacctcctagctgaac

SEQ ID NO: 10549 - DNA, 20 bp, Artificial Sequence
  Description of Artificial Sequence: Synthetic oligonucleotide
  Target: AGXT; (+) strand; PAM type: NRG; PAM sequence: AGG
gattacctcctagctgaaca

SEQ ID NO: 10550 - DNA, 20 bp, Artificial Sequence
  Description of Artificial Sequence: Synthetic oligonucleotide
  Target: AGXT; (+) strand; PAM type: NRG; PAM sequence: GAG
ttacctcctagctgaacaag

SEQ ID NO: 10551 - DNA, 20 bp, Artificial Sequence
  Description of Artificial Sequence: Synthetic oligonucleotide
  Target: AGXT; (+) strand; PAM type: NRG; PAM sequence: AGG
tacctcctagctgaacaagg

SEQ ID NO: 10552 - DNA, 20 bp, Artificial Sequence
  Description of Artificial Sequence: Synthetic oligonucleotide
  Target: AGXT; (+) strand; PAM type: NRG; PAM sequence: GGG
acctcctagctgaacaagga

SEQ ID NO: 10553 - DNA, 20 bp, Artificial Sequence
  Description of Artificial Sequence: Synthetic oligonucleotide
  Target: AGXT; (+) strand; PAM type: NRG; PAM sequence: GGG
cctcctagctgaacaaggag

SEQ ID NO: 10554 - DNA, 20 bp, Artificial Sequence
  Description of Artificial Sequence: Synthetic oligonucleotide
  Target: AGXT; (+) strand; PAM type: NRG; PAM sequence: CAG
ggggtctgtgctgtcatcaa

SEQ ID NO: 10555 - DNA, 20 bp, Artificial Sequence
  Description of Artificial Sequence: Synthetic oligonucleotide
  Target: AGXT; (+) strand; PAM type: NRG; PAM sequence: AGG
gggtctgtgctgtcatcaac

SEQ ID NO: 10556 - DNA, 20 bp, Artificial Sequence
  Description of Artificial Sequence: Synthetic oligonucleotide
  Target: AGXT; (+) strand; PAM type: NRG; PAM sequence: TGG
tgcacctacatttatgtgtc

SEQ ID NO: 10557 - DNA, 20 bp, Artificial Sequence
  Description of Artificial Sequence: Synthetic oligonucleotide
  Target: AGXT; (+) strand; PAM type: NRG; PAM sequence: GAG
cacctacatttatgtgtctg

SEQ ID NO: 10558 - DNA, 20 bp, Artificial Sequence
  Description of Artificial Sequence: Synthetic oligonucleotide
  Target: AGXT; (+) strand; PAM type: NRG; PAM sequence: AAG
ctacatttatgtgtctggag

SEQ ID NO: 10559 - DNA, 20 bp, Artificial Sequence
  Description of Artificial Sequence: Synthetic oligonucleotide
  Target: AGXT; (+) strand; PAM type: NRG; PAM sequence: TGG
catttatgtgtctggagaag

SEQ ID NO: 10560 - DNA, 20 bp, Artificial Sequence
  Description of Artificial Sequence: Synthetic oligonucleotide
  Target: AGXT; (+) strand; PAM type: NRG; PAM sequence: AAG
agaagtggaaaccgatgccc

SEQ ID NO: 10561 - DNA, 20 bp, Artificial Sequence
  Description of Artificial Sequence: Synthetic oligonucleotide
  Target: AGXT; (+) strand; PAM type: NRG; PAM sequence: AAG
tgcccaagaaatcatcaaac

SEQ ID NO: 10562 - DNA, 20 bp, Artificial Sequence
  Description of Artificial Sequence: Synthetic oligonucleotide
  Target: AGXT; (+) strand; PAM type: NRG; PAM sequence: TGG
aaatcatcaaacaagccaaa

SEQ ID NO: 10563 - DNA, 20 bp, Artificial Sequence
  Description of Artificial Sequence: Synthetic oligonucleotide
  Target: AGXT; (+) strand; PAM type: NRG; PAM sequence: AAG
tggctacacacactttccca

SEQ ID NO: 10564 - DNA, 20 bp, Artificial Sequence
  Description of Artificial Sequence: Synthetic oligonucleotide
  Target: AGXT; (+) strand; PAM type: NRG; PAM sequence: AAG
cacactttcccaaagcaacc

SEQ ID NO: 10565 - DNA, 20 bp, Artificial Sequence
  Description of Artificial Sequence: Synthetic oligonucleotide
  Target: AGXT; (+) strand; PAM type: NRG; PAM sequence: TGG
tttcccaaagcaaccaagac

SEQ ID NO: 10566 - DNA, 20 bp, Artificial Sequence
  Description of Artificial Sequence: Synthetic oligonucleotide
  Target: AGXT; (+) strand; PAM type: NRG; PAM sequence: GGG
ttcccaaagcaaccaagact

SEQ ID NO: 10567 - DNA, 20 bp, Artificial Sequence
  Description of Artificial Sequence: Synthetic oligonucleotide
  Target: AGXT; (+) strand; PAM type: NRG; PAM sequence: TGG
gggccaaaacttttactgat

SEQ ID NO: 10568 - DNA, 20 bp, Artificial Sequence
  Description of Artificial Sequence: Synthetic oligonucleotide
  Target: AGXT; (+) strand; PAM type: NRG; PAM sequence: TGG
ttggttttcaaaaaatcact

SEQ ID NO: 10569 - DNA, 20 bp, Artificial Sequence
  Description of Artificial Sequence: Synthetic oligonucleotide
  Target: AGXT; (+) strand; PAM type: NRG; PAM sequence: TAG
acttggcttcccccattcct

SEQ ID NO: 10570 - DNA, 20 bp, Artificial Sequence
  Description of Artificial Sequence: Synthetic oligonucleotide
  Target: AGXT; (+) strand; PAM type: NRG; PAM sequence: TGG
gtcatttttcttttaatatt

SEQ ID NO: 10571 - DNA, 20 bp, Artificial Sequence
  Description of Artificial Sequence: Synthetic oligonucleotide
  Target: AGXT; (+) strand; PAM type: NRG; PAM sequence: GAG
tgcttttctatgttctacat

SEQ ID NO: 10572 - DNA, 20 bp, Artificial Sequence
  Description of Artificial Sequence: Synthetic oligonucleotide
  Target: AGXT; (+) strand; PAM type: NRG; PAM sequence: CAG
catgagaacaattccacctg

SEQ ID NO: 10573 - DNA, 20 bp, Artificial Sequence
  Description of Artificial Sequence: Synthetic oligonucleotide
  Target: AGXT; (+) strand; PAM type: NRG; PAM sequence: AAG
gagaacaattccacctgcag

SEQ ID NO: 10574 - DNA, 20 bp, Artificial Sequence
  Description of Artificial Sequence: Synthetic oligonucleotide
  Target: AGXT; (+) strand; PAM type: NRG; PAM sequence: AGG
agaacaattccacctgcaga

SEQ ID NO: 10575 - DNA, 20 bp, Artificial Sequence
  Description of Artificial Sequence: Synthetic oligonucleotide
  Target: AGXT; (+) strand; PAM type: NRG; PAM sequence: TGG
aggctatgcattcccaacac

SEQ ID NO: 10576 - DNA, 20 bp, Artificial Sequence
  Description of Artificial Sequence: Synthetic oligonucleotide
  Target: AGXT; (+) strand; PAM type: NRG; PAM sequence: CAG
ccaacactggcctgcaactg

SEQ ID NO: 10577 - DNA, 20 bp, Artificial Sequence
  Description of Artificial Sequence: Synthetic oligonucleotide
  Target: AGXT; (+) strand; PAM type: NRG; PAM sequence: TGG
caactgcagctcgatttaca

SEQ ID NO: 10578 - DNA, 20 bp, Artificial Sequence
  Description of Artificial Sequence: Synthetic oligonucleotide
  Target: AGXT; (+) strand; PAM type: NRG; PAM sequence: GGG
aactgcagctcgatttacat

SEQ ID NO: 10579 - DNA, 20 bp, Artificial Sequence
  Description of Artificial Sequence: Synthetic oligonucleotide
  Target: AGXT; (+) strand; PAM type: NRG; PAM sequence: GGG
actgcagctcgatttacatg

SEQ ID NO: 10580 - DNA, 20 bp, Artificial Sequence
  Description of Artificial Sequence: Synthetic oligonucleotide
  Target: AGXT; (+) strand; PAM type: NRG; PAM sequence: TGG
atttacatggggcttcttga

SEQ ID NO: 10581 - DNA, 20 bp, Artificial Sequence
  Description of Artificial Sequence: Synthetic oligonucleotide
  Target: AGXT; (+) strand; PAM type: NRG; PAM sequence: CGG
gggcttcttgatggaaatac

SEQ ID NO: 10582 - DNA, 20 bp, Artificial Sequence
  Description of Artificial Sequence: Synthetic oligonucleotide
  Target: AGXT; (+) strand; PAM type: NRG; PAM sequence: CAG
gaaataccggcctgcaactg

SEQ ID NO: 10583 - DNA, 20 bp, Artificial Sequence
  Description of Artificial Sequence: Synthetic oligonucleotide
  Target: AGXT; (+) strand; PAM type: NRG; PAM sequence: TGG
aactgcagctcccatttacg

SEQ ID NO: 10584 - DNA, 20 bp, Artificial Sequence
  Description of Artificial Sequence: Synthetic oligonucleotide
  Target: AGXT; (+) strand; PAM type: NRG; PAM sequence: GGG
actgcagctcccatttacgt

SEQ ID NO: 10585 - DNA, 20 bp, Artificial Sequence
  Description of Artificial Sequence: Synthetic oligonucleotide
  Target: AGXT; (+) strand; PAM type: NRG; PAM sequence: GGG
ctgcagctcccatttacgtg

SEQ ID NO: 10586 - DNA, 20 bp, Artificial Sequence
  Description of Artificial Sequence: Synthetic oligonucleotide
  Target: AGXT; (+) strand; PAM type: NRG; PAM sequence: TGG
atttacgtggggcttcttga

SEQ ID NO: 10587 - DNA, 20 bp, Artificial Sequence
  Description of Artificial Sequence: Synthetic oligonucleotide
  Target: AGXT; (+) strand; PAM type: NRG; PAM sequence: AAG
catcacgtgcctccgtgcac

SEQ ID NO: 10588 - DNA, 20 bp, Artificial Sequence
  Description of Artificial Sequence: Synthetic oligonucleotide
  Target: AGXT; (+) strand; PAM type: NRG; PAM sequence: GAG
cctttattcccttcatgacc

SEQ ID NO: 10589 - DNA, 20 bp, Artificial Sequence
  Description of Artificial Sequence: Synthetic oligonucleotide
  Target: AGXT; (+) strand; PAM type: NRG; PAM sequence: GAG
tttattcccttcatgaccga

SEQ ID NO: 10590 - DNA, 20 bp, Artificial Sequence
  Description of Artificial Sequence: Synthetic oligonucleotide
  Target: AGXT; (+) strand; PAM type: NRG; PAM sequence: AAG
ttcccttcatgaccgagagc

SEQ ID NO: 10591 - DNA, 20 bp, Artificial Sequence
  Description of Artificial Sequence: Synthetic oligonucleotide
  Target: AGXT; (+) strand; PAM type: NRG; PAM sequence: AAG
cttcatgaccgagagcaaga

SEQ ID NO: 10592 - DNA, 20 bp, Artificial Sequence
  Description of Artificial Sequence: Synthetic oligonucleotide
  Target: AGXT; (+) strand; PAM type: NRG; PAM sequence: AGG
ttcatgaccgagagcaagaa

SEQ ID NO: 10593 - DNA, 20 bp, Artificial Sequence
  Description of Artificial Sequence: Synthetic oligonucleotide
  Target: AGXT; (+) strand; PAM type: NRG; PAM sequence: GGG
tcatgaccgagagcaagaaa

SEQ ID NO: 10594 - DNA, 20 bp, Artificial Sequence
  Description of Artificial Sequence: Synthetic oligonucleotide
  Target: AGXT; (+) strand; PAM type: NRG; PAM sequence: CAG
tacccccctgaactcccttt

SEQ ID NO: 10595 - DNA, 20 bp, Artificial Sequence
  Description of Artificial Sequence: Synthetic oligonucleotide
  Target: AGXT; (+) strand; PAM type: NRG; PAM sequence: CAG
ccccctgaactccctttcag

SEQ ID NO: 10596 - DNA, 20 bp, Artificial Sequence
  Description of Artificial Sequence: Synthetic oligonucleotide
  Target: AGXT; (+) strand; PAM type: NRG; PAM sequence: AAG
ctgaactccctttcagcagc

SEQ ID NO: 10597 - DNA, 20 bp, Artificial Sequence
  Description of Artificial Sequence: Synthetic oligonucleotide
  Target: AGXT; (+) strand; PAM type: NRG; PAM sequence: TAG
aactccctttcagcagcaag

SEQ ID NO: 10598 - DNA, 20 bp, Artificial Sequence
  Description of Artificial Sequence: Synthetic oligonucleotide
  Target: AGXT; (+) strand; PAM type: NRG; PAM sequence: CAG
ccctttcagcagcaagtagt

SEQ ID NO: 10599 - DNA, 20 bp, Artificial Sequence
  Description of Artificial Sequence: Synthetic oligonucleotide
  Target: AGXT; (+) strand; PAM type: NRG; PAM sequence: AGG
cctttcagcagcaagtagtc

SEQ ID NO: 10600 - DNA, 20 bp, Artificial Sequence
  Description of Artificial Sequence: Synthetic oligonucleotide
  Target: AGXT; (+) strand; PAM type: NRG; PAM sequence: TGG
cagcaagtagtcaggcgcac

SEQ ID NO: 10601 - DNA, 20 bp, Artificial Sequence
  Description of Artificial Sequence: Synthetic oligonucleotide
  Target: AGXT; (+) strand; PAM type: NRG; PAM sequence: GAG
tgtgccgtttcccctttctt

SEQ ID NO: 10602 - DNA, 20 bp, Artificial Sequence
  Description of Artificial Sequence: Synthetic oligonucleotide
  Target: AGXT; (+) strand; PAM type: NRG; PAM sequence: CAG
cccctttcttgagaccccaa

SEQ ID NO: 10603 - DNA, 20 bp, Artificial Sequence
  Description of Artificial Sequence: Synthetic oligonucleotide
  Target: AGXT; (+) strand; PAM type: NRG; PAM sequence: AGG
ccctttcttgagaccccaac

SEQ ID NO: 10604 - DNA, 20 bp, Artificial Sequence
  Description of Artificial Sequence: Synthetic oligonucleotide
  Target: AGXT; (+) strand; PAM type: NRG; PAM sequence: AAG
tttcttgagaccccaacagg

SEQ ID NO: 10605 - DNA, 20 bp, Artificial Sequence
  Description of Artificial Sequence: Synthetic oligonucleotide
  Target: AGXT; (+) strand; PAM type: NRG; PAM sequence: CAG
cttgagaccccaacaggaag

SEQ ID NO: 10606 - DNA, 20 bp, Artificial Sequence
  Description of Artificial Sequence: Synthetic oligonucleotide
  Target: AGXT; (+) strand; PAM type: NRG; PAM sequence: AGG
ttgagaccccaacaggaagc

SEQ ID NO: 10607 - DNA, 20 bp, Artificial Sequence
  Description of Artificial Sequence: Synthetic oligonucleotide
  Target: AGXT; (+) strand; PAM type: NRG; PAM sequence: TGG
agaccccaacaggaagcagg

SEQ ID NO: 10608 - DNA, 20 bp, Artificial Sequence
  Description of Artificial Sequence: Synthetic oligonucleotide
  Target: AGXT; (+) strand; PAM type: NRG; PAM sequence: GAG
aacaggaagcaggtggacat

SEQ ID NO: 10609 - DNA, 20 bp, Artificial Sequence
  Description of Artificial Sequence: Synthetic oligonucleotide
  Target: AGXT; (+) strand; PAM type: NRG; PAM sequence: TGG
gaagcaggtggacatgagca

SEQ ID NO: 10610 - DNA, 20 bp, Artificial Sequence
  Description of Artificial Sequence: Synthetic oligonucleotide
  Target: AGXT; (+) strand; PAM type: NRG; PAM sequence: CAG
gcaggtggacatgagcatgg

SEQ ID NO: 10611 - DNA, 20 bp, Artificial Sequence
  Description of Artificial Sequence: Synthetic oligonucleotide
  Target: AGXT; (+) strand; PAM type: NRG; PAM sequence: AAG
tggacatgagcatggcagaa

SEQ ID NO: 10612 - DNA, 20 bp, Artificial Sequence
  Description of Artificial Sequence: Synthetic oligonucleotide
  Target: AGXT; (+) strand; PAM type: NRG; PAM sequence: AGG
ggacatgagcatggcagaaa

SEQ ID NO: 10613 - DNA, 20 bp, Artificial Sequence
  Description of Artificial Sequence: Synthetic oligonucleotide
  Target: AGXT; (+) strand; PAM type: NRG; PAM sequence: AAG
catgagcatggcagaaaagg

SEQ ID NO: 10614 - DNA, 20 bp, Artificial Sequence
  Description of Artificial Sequence: Synthetic oligonucleotide
  Target: AGXT; (+) strand; PAM type: NRG; PAM sequence: AGG
atgagcatggcagaaaagga

SEQ ID NO: 10615 - DNA, 20 bp, Artificial Sequence
  Description of Artificial Sequence: Synthetic oligonucleotide
  Target: AGXT; (+) strand; PAM type: NRG; PAM sequence: GGG
tgagcatggcagaaaaggaa

SEQ ID NO: 10616 - DNA, 20 bp, Artificial Sequence
  Description of Artificial Sequence: Synthetic oligonucleotide
  Target: AGXT; (+) strand; PAM type: NRG; PAM sequence: AAG
tggcagaaaaggaagggtca

SEQ ID NO: 10617 - DNA, 20 bp, Artificial Sequence
  Description of Artificial Sequence: Synthetic oligonucleotide
  Target: AGXT; (+) strand; PAM type: NRG; PAM sequence: AAG
gaagggtcaaagatttcacc

SEQ ID NO: 10618 - DNA, 20 bp, Artificial Sequence
  Description of Artificial Sequence: Synthetic oligonucleotide
  Target: AGXT; (+) strand; PAM type: NRG; PAM sequence: CAG
gatttcaccaagatatttgt

SEQ ID NO: 10619 - DNA, 20 bp, Artificial Sequence
  Description of Artificial Sequence: Synthetic oligonucleotide
  Target: AGXT; (+) strand; PAM type: NRG; PAM sequence: GAG
tttcaccaagatatttgtca

SEQ ID NO: 10620 - DNA, 20 bp, Artificial Sequence
  Description of Artificial Sequence: Synthetic oligonucleotide
  Target: AGXT; (+) strand; PAM type: NRG; PAM sequence: AGG
ttcaccaagatatttgtcag

SEQ ID NO: 10621 - DNA, 20 bp, Artificial Sequence
  Description of Artificial Sequence: Synthetic oligonucleotide
  Target: AGXT; (+) strand; PAM type: NRG; PAM sequence: GGG
tcaccaagatatttgtcaga

SEQ ID NO: 10622 - DNA, 20 bp, Artificial Sequence
  Description of Artificial Sequence: Synthetic oligonucleotide
  Target: AGXT; (+) strand; PAM type: NRG; PAM sequence: GAG
atatttgtcagagggaaaat

SEQ ID NO: 10623 - DNA, 20 bp, Artificial Sequence
  Description of Artificial Sequence: Synthetic oligonucleotide
  Target: AGXT; (+) strand; PAM type: NRG; PAM sequence: AGG
tatttgtcagagggaaaatg

SEQ ID NO: 10624 - DNA, 20 bp, Artificial Sequence
  Description of Artificial Sequence: Synthetic oligonucleotide
  Target: AGXT; (+) strand; PAM type: NRG; PAM sequence: CAG
tgtcagagggaaaatgagga

SEQ ID NO: 10625 - DNA, 20 bp, Artificial Sequence
  Description of Artificial Sequence: Synthetic oligonucleotide
  Target: AGXT; (+) strand; PAM type: NRG; PAM sequence: AAG
gagggaaaatgaggacagca

SEQ ID NO: 10626 - DNA, 20 bp, Artificial Sequence
  Description of Artificial Sequence: Synthetic oligonucleotide
  Target: AGXT; (+) strand; PAM type: NRG; PAM sequence: TGG
tgaggacagcaaagatcacc

SEQ ID NO: 10627 - DNA, 20 bp, Artificial Sequence
  Description of Artificial Sequence: Synthetic oligonucleotide
  Target: AGXT; (+) strand; PAM type: NRG; PAM sequence: GAG
aggacagcaaagatcacctg

SEQ ID NO: 10628 - DNA, 20 bp, Artificial Sequence
  Description of Artificial Sequence: Synthetic oligonucleotide
  Target: AGXT; (+) strand; PAM type: NRG; PAM sequence: AAG
aagatcacctggagaccatc

SEQ ID NO: 10629 - DNA, 20 bp, Artificial Sequence
  Description of Artificial Sequence: Synthetic oligonucleotide
  Target: AGXT; (+) strand; PAM type: NRG; PAM sequence: CAG
atcacctggagaccatcaag

SEQ ID NO: 10630 - DNA, 20 bp, Artificial Sequence
  Description of Artificial Sequence: Synthetic oligonucleotide
  Target: AGXT; (+) strand; PAM type: NRG; PAM sequence: AGG
tcacctggagaccatcaagc

SEQ ID NO: 10631 - DNA, 20 bp, Artificial Sequence
  Description of Artificial Sequence: Synthetic oligonucleotide
  Target: AGXT; (+) strand; PAM type: NRG; PAM sequence: CAG
ggagaccatcaagcaggccc

SEQ ID NO: 10632 - DNA, 20 bp, Artificial Sequence
  Description of Artificial Sequence: Synthetic oligonucleotide
  Target: AGXT; (+) strand; PAM type: NRG; PAM sequence: AGG
gagaccatcaagcaggcccc

SEQ ID NO: 10633 - DNA, 20 bp, Artificial Sequence
  Description of Artificial Sequence: Synthetic oligonucleotide
  Target: AGXT; (+) strand; PAM type: NRG; PAM sequence: TGG
accatcaagcaggccccagg

SEQ ID NO: 10634 - DNA, 20 bp, Artificial Sequence
  Description of Artificial Sequence: Synthetic oligonucleotide
  Target: AGXT; (+) strand; PAM type: NRG; PAM sequence: GGG
ccatcaagcaggccccaggt

SEQ ID NO: 10635 - DNA, 20 bp, Artificial Sequence
  Description of Artificial Sequence: Synthetic oligonucleotide
  Target: AGXT; (+) strand; PAM type: NRG; PAM sequence: GGG
catcaagcaggccccaggtg

SEQ ID NO: 10636 - DNA, 20 bp, Artificial Sequence
  Description of Artificial Sequence: Synthetic oligonucleotide
  Target: AGXT; (+) strand; PAM type: NRG; PAM sequence: TGG
caagcaggccccaggtgggg

SEQ ID NO: 10637 - DNA, 20 bp, Artificial Sequence
  Description of Artificial Sequence: Synthetic oligonucleotide
  Target: AGXT; (+) strand; PAM type: NRG; PAM sequence: GGG
aagcaggccccaggtggggt

SEQ ID NO: 10638 - DNA, 20 bp, Artificial Sequence
  Description of Artificial Sequence: Synthetic oligonucleotide
  Target: AGXT; (+) strand; PAM type: NRG; PAM sequence: TGG
caggccccaggtggggtggg

SEQ ID NO: 10639 - DNA, 20 bp, Artificial Sequence
  Description of Artificial Sequence: Synthetic oligonucleotide
  Target: AGXT; (+) strand; PAM type: NRG; PAM sequence: GAG
ggccccaggtggggtgggtg

SEQ ID NO: 10640 - DNA, 20 bp, Artificial Sequence
  Description of Artificial Sequence: Synthetic oligonucleotide
  Target: AGXT; (+) strand; PAM type: NRG; PAM sequence: AGG
gccccaggtggggtgggtgg

SEQ ID NO: 10641 - DNA, 20 bp, Artificial Sequence
  Description of Artificial Sequence: Synthetic oligonucleotide
  Target: AGXT; (+) strand; PAM type: NRG; PAM sequence: GGG
ccccaggtggggtgggtgga

SEQ ID NO: 10642 - DNA, 20 bp, Artificial Sequence
  Description of Artificial Sequence: Synthetic oligonucleotide
  Target: AGXT; (+) strand; PAM type: NRG; PAM sequence: GGG
cccaggtggggtgggtggag

SEQ ID NO: 10643 - DNA, 20 bp, Artificial Sequence
  Description of Artificial Sequence: Synthetic oligonucleotide
  Target: AGXT; (+) strand; PAM type: NRG; PAM sequence: GAG
caggtggggtgggtggaggg

SEQ ID NO: 10644 - DNA, 20 bp, Artificial Sequence
  Description of Artificial Sequence: Synthetic oligonucleotide
  Target: AGXT; (+) strand; PAM type: NRG; PAM sequence: GAG
ggaggggagcctctttattt

SEQ ID NO: 10645 - DNA, 20 bp, Artificial Sequence
  Description of Artificial Sequence: Synthetic oligonucleotide
  Target: AGXT; (+) strand; PAM type: NRG; PAM sequence: TAG
gcctctttatttgagaaatg

SEQ ID NO: 10646 - DNA, 20 bp, Artificial Sequence
  Description of Artificial Sequence: Synthetic oligonucleotide
  Target: AGXT; (+) strand; PAM type: NRG; PAM sequence: TAG
ttgagaaatgtagaatgaat

SEQ ID NO: 10647 - DNA, 20 bp, Artificial Sequence
  Description of Artificial Sequence: Synthetic oligonucleotide
  Target: AGXT; (+) strand; PAM type: NRG; PAM sequence: AAG
ttagacttccctattatcta

SEQ ID NO: 10648 - DNA, 20 bp, Artificial Sequence
  Description of Artificial Sequence: Synthetic oligonucleotide
  Target: AGXT; (+) strand; PAM type: NRG; PAM sequence: TGG
acttccctattatctaaagt

SEQ ID NO: 10649 - DNA, 20 bp, Artificial Sequence
  Description of Artificial Sequence: Synthetic oligonucleotide
  Target: AGXT; (+) strand; PAM type: NRG; PAM sequence: TGG
tattatctaaagttggcacc

SEQ ID NO: 10650 - DNA, 20 bp, Artificial Sequence
  Description of Artificial Sequence: Synthetic oligonucleotide
  Target: AGXT; (+) strand; PAM type: NRG; PAM sequence: CAG
ctaaagttggcacctggttc

SEQ ID NO: 10651 - DNA, 20 bp, Artificial Sequence
  Description of Artificial Sequence: Synthetic oligonucleotide
  Target: AGXT; (+) strand; PAM type: NRG; PAM sequence: AGG
taaagttggcacctggttcc

SEQ ID NO: 10652 - DNA, 20 bp, Artificial Sequence
  Description of Artificial Sequence: Synthetic oligonucleotide
  Target: AGXT; (+) strand; PAM type: NRG; PAM sequence: TAG
acctaaaacttatacataac

SEQ ID NO: 10653 - DNA, 20 bp, Artificial Sequence
  Description of Artificial Sequence: Synthetic oligonucleotide
  Target: AGXT; (+) strand; PAM type: NRG; PAM sequence: TGG
ctagaatttctatacatctc

SEQ ID NO: 10654 - DNA, 20 bp, Artificial Sequence
  Description of Artificial Sequence: Synthetic oligonucleotide
  Target: AGXT; (+) strand; PAM type: NRG; PAM sequence: CAG
ttctatacatctctggaatg

SEQ ID NO: 10655 - DNA, 20 bp, Artificial Sequence
  Description of Artificial Sequence: Synthetic oligonucleotide
  Target: AGXT; (+) strand; PAM type: NRG; PAM sequence: CAG
gtgtgtgtctgtataccatg

SEQ ID NO: 10656 - DNA, 20 bp, Artificial Sequence
  Description of Artificial Sequence: Synthetic oligonucleotide
  Target: AGXT; (+) strand; PAM type: NRG; PAM sequence: AGG
tgtgtgtctgtataccatgc

SEQ ID NO: 10657 - DNA, 20 bp, Artificial Sequence
  Description of Artificial Sequence: Synthetic oligonucleotide
  Target: AGXT; (+) strand; PAM type: NRG; PAM sequence: GAG
gcaggtttgcttgctaaatt

SEQ ID NO: 10658 - DNA, 20 bp, Artificial Sequence
  Description of Artificial Sequence: Synthetic oligonucleotide
  Target: AGXT; (+) strand; PAM type: NRG; PAM sequence: AAG
aattgagcctgtaaaccaaa

SEQ ID NO: 10659 - DNA, 20 bp, Artificial Sequence
  Description of Artificial Sequence: Synthetic oligonucleotide
  Target: AGXT; (+) strand; PAM type: NRG; PAM sequence: CAG
aaaccaaaaagtacctcaaa

SEQ ID NO: 10660 - DNA, 20 bp, Artificial Sequence
  Description of Artificial Sequence: Synthetic oligonucleotide
  Target: AGXT; (+) strand; PAM type: NRG; PAM sequence: AGG
aaccaaaaagtacctcaaac

SEQ ID NO: 10661 - DNA, 20 bp, Artificial Sequence
  Description of Artificial Sequence: Synthetic oligonucleotide
  Target: AGXT; (+) strand; PAM type: NRG; PAM sequence: TAG
caaacaggtctcaattaatt

SEQ ID NO: 10662 - DNA, 20 bp, Artificial Sequence
  Description of Artificial Sequence: Synthetic oligonucleotide
  Target: AGXT; (+) strand; PAM type: NRG; PAM sequence: AAG
caggtctcaattaatttaga

SEQ ID NO: 10663 - DNA, 20 bp, Artificial Sequence
  Description of Artificial Sequence: Synthetic oligonucleotide
  Target: AGXT; (+) strand; PAM type: NRG; PAM sequence: AAG
tttagaaagtttttgttgcc

SEQ ID NO: 10664 - DNA, 20 bp, Artificial Sequence
  Description of Artificial Sequence: Synthetic oligonucleotide
  Target: AGXT; (+) strand; PAM type: NRG; PAM sequence: AGG
ttagaaagtttttgttgcca

SEQ ID NO: 10665 - DNA, 20 bp, Artificial Sequence
  Description of Artificial Sequence: Synthetic oligonucleotide
  Target: AGXT; (+) strand; PAM type: NRG; PAM sequence: AAG
aagtttttgttgccaaggct

SEQ ID NO: 10666 - DNA, 20 bp, Artificial Sequence
  Description of Artificial Sequence: Synthetic oligonucleotide
  Target: AGXT; (+) strand; PAM type: NRG; PAM sequence: AGG
agtttttgttgccaaggcta

SEQ ID NO: 10667 - DNA, 20 bp, Artificial Sequence
  Description of Artificial Sequence: Synthetic oligonucleotide
  Target: AGXT; (+) strand; PAM type: NRG; PAM sequence: TGG
caaggctaaggatgcacccg

SEQ ID NO: 10668 - DNA, 20 bp, Artificial Sequence
  Description of Artificial Sequence: Synthetic oligonucleotide
  Target: AGXT; (+) strand; PAM type: NRG; PAM sequence: CAG
ctaaggatgcacccgtggta

SEQ ID NO: 10669 - DNA, 20 bp, Artificial Sequence
  Description of Artificial Sequence: Synthetic oligonucleotide
  Target: AGXT; (+) strand; PAM type: NRG; PAM sequence: CAG
atgcacccgtggtacagcct

SEQ ID NO: 10670 - DNA, 20 bp, Artificial Sequence
  Description of Artificial Sequence: Synthetic oligonucleotide
  Target: AGXT; (+) strand; PAM type: NRG; PAM sequence: AGG
tgcacccgtggtacagcctc

SEQ ID NO: 10671 - DNA, 20 bp, Artificial Sequence
  Description of Artificial Sequence: Synthetic oligonucleotide
  Target: AGXT; (+) strand; PAM type: NRG; PAM sequence: GAG
cacccgtggtacagcctcag

SEQ ID NO: 10672 - DNA, 20 bp, Artificial Sequence
  Description of Artificial Sequence: Synthetic oligonucleotide
  Target: AGXT; (+) strand; PAM type: NRG; PAM sequence: AGG
acccgtggtacagcctcagg

SEQ ID NO: 10673 - DNA, 20 bp, Artificial Sequence
  Description of Artificial Sequence: Synthetic oligonucleotide
  Target: AGXT; (+) strand; PAM type: NRG; PAM sequence: GGG
cccgtggtacagcctcagga

SEQ ID NO: 10674 - DNA, 20 bp, Artificial Sequence
  Description of Artificial Sequence: Synthetic oligonucleotide
  Target: AGXT; (+) strand; PAM type: NRG; PAM sequence: GAG
cgtggtacagcctcaggagg

SEQ ID NO: 10675 - DNA, 20 bp, Artificial Sequence
  Description of Artificial Sequence: Synthetic oligonucleotide
  Target: AGXT; (+) strand; PAM type: NRG; PAM sequence: AGG
gtggtacagcctcaggaggg

SEQ ID NO: 10676 - DNA, 20 bp, Artificial Sequence
  Description of Artificial Sequence: Synthetic oligonucleotide
  Target: AGXT; (+) strand; PAM type: NRG; PAM sequence: AAG
ggagggaggacatccttgcc

SEQ ID NO: 10677 - DNA, 20 bp, Artificial Sequence
  Description of Artificial Sequence: Synthetic oligonucleotide
  Target: AGXT; (+) strand; PAM type: NRG; PAM sequence: AAG
aggacatccttgccaagctc

SEQ ID NO: 10678 - DNA, 20 bp, Artificial Sequence
  Description of Artificial Sequence: Synthetic oligonucleotide
  Target: AGXT; (+) strand; PAM type: NRG; PAM sequence: AGG
ggacatccttgccaagctca

SEQ ID NO: 10679 - DNA, 20 bp, Artificial Sequence
  Description of Artificial Sequence: Synthetic oligonucleotide
  Target: AGXT; (+) strand; PAM type: NRG; PAM sequence: GGG
gacatccttgccaagctcaa

SEQ ID NO: 10680 - DNA, 20 bp, Artificial Sequence
  Description of Artificial Sequence: Synthetic oligonucleotide
  Target: AGXT; (+) strand; PAM type: NRG; PAM sequence: AAG
aagggtgcacccctgaccac

SEQ ID NO: 10681 - DNA, 20 bp, Artificial Sequence
  Description of Artificial Sequence: Synthetic oligonucleotide
  Target: AGXT; (+) strand; PAM type: NRG; PAM sequence: AGG
agggtgcacccctgaccaca

SEQ ID NO: 10682 - DNA, 20 bp, Artificial Sequence
  Description of Artificial Sequence: Synthetic oligonucleotide
  Target: AGXT; (+) strand; PAM type: NRG; PAM sequence: GGG
gggtgcacccctgaccacaa

SEQ ID NO: 10683 - DNA, 20 bp, Artificial Sequence
  Description of Artificial Sequence: Synthetic oligonucleotide
  Target: AGXT; (+) strand; PAM type: NRG; PAM sequence: AAG
acccctgaccacaagggccc

SEQ ID NO: 10684 - DNA, 20 bp, Artificial Sequence
  Description of Artificial Sequence: Synthetic oligonucleotide
  Target: AGXT; (+) strand; PAM type: NRG; PAM sequence: AGG
cccctgaccacaagggccca

SEQ ID NO: 10685 - DNA, 20 bp, Artificial Sequence
  Description of Artificial Sequence: Synthetic oligonucleotide
  Target: AGXT; (+) strand; PAM type: NRG; PAM sequence: TGG
ctgaccacaagggcccaagg

SEQ ID NO: 10686 - DNA, 20 bp, Artificial Sequence
  Description of Artificial Sequence: Synthetic oligonucleotide
  Target: AGXT; (+) strand; PAM type: NRG; PAM sequence: CGG
ccacaagggcccaaggtggt

SEQ ID NO: 10687 - DNA, 20 bp, Artificial Sequence
  Description of Artificial Sequence: Synthetic oligonucleotide
  Target: AGXT; (+) strand; PAM type: NRG; PAM sequence: GGG
cacaagggcccaaggtggtc

SEQ ID NO: 10688 - DNA, 20 bp, Artificial Sequence
  Description of Artificial Sequence: Synthetic oligonucleotide
  Target: AGXT; (+) strand; PAM type: NRG; PAM sequence: GGG
acaagggcccaaggtggtcg

SEQ ID NO: 10689 - DNA, 20 bp, Artificial Sequence
  Description of Artificial Sequence: Synthetic oligonucleotide
  Target: AGXT; (+) strand; PAM type: NRG; PAM sequence: CAG
ggcccaaggtggtcggggca

SEQ ID NO: 10690 - DNA, 20 bp, Artificial Sequence
  Description of Artificial Sequence: Synthetic oligonucleotide
  Target: AGXT; (+) strand; PAM type: NRG; PAM sequence: TAG
cagcttgcttttatacattt

SEQ ID NO: 10691 - DNA, 20 bp, Artificial Sequence
  Description of Artificial Sequence: Synthetic oligonucleotide
  Target: AGXT; (+) strand; PAM type: NRG; PAM sequence: AGG
agcttgcttttatacatttt

SEQ ID NO: 10692 - DNA, 20 bp, Artificial Sequence
  Description of Artificial Sequence: Synthetic oligonucleotide
  Target: AGXT; (+) strand; PAM type: NRG; PAM sequence: GGG
gcttgcttttatacatttta

SEQ ID NO: 10693 - DNA, 20 bp, Artificial Sequence
  Description of Artificial Sequence: Synthetic oligonucleotide
  Target: AGXT; (+) strand; PAM type: NRG; PAM sequence: GAG
ttgcttttatacattttagg

SEQ ID NO: 10694 - DNA, 20 bp, Artificial Sequence
  Description of Artificial Sequence: Synthetic oligonucleotide
  Target: AGXT; (+) strand; PAM type: NRG; PAM sequence: GAG
tatacattttagggagatat

SEQ ID NO: 10695 - DNA, 20 bp, Artificial Sequence
  Description of Artificial Sequence: Synthetic oligonucleotide
  Target: AGXT; (+) strand; PAM type: NRG; PAM sequence: AGG
atacattttagggagatatg

SEQ ID NO: 10696 - DNA, 20 bp, Artificial Sequence
  Description of Artificial Sequence: Synthetic oligonucleotide
  Target: AGXT; (+) strand; PAM type: NRG; PAM sequence: TGG
atgaggcatcaatcaataca

SEQ ID NO: 10697 - DNA, 20 bp, Artificial Sequence
  Description of Artificial Sequence: Synthetic oligonucleotide
  Target: AGXT; (+) strand; PAM type: NRG; PAM sequence: GGG
tgaggcatcaatcaatacat

SEQ ID NO: 10698 - DNA, 20 bp, Artificial Sequence
  Description of Artificial Sequence: Synthetic oligonucleotide
  Target: AGXT; (+) strand; PAM type: NRG; PAM sequence: GAG
aggcatcaatcaatacatgg

SEQ ID NO: 10699 - DNA, 20 bp, Artificial Sequence
  Description of Artificial Sequence: Synthetic oligonucleotide
  Target: AGXT; (+) strand; PAM type: NRG; PAM sequence: TGG
aatacatgggagatttacat

SEQ ID NO: 10700 - DNA, 20 bp, Artificial Sequence
  Description of Artificial Sequence: Synthetic oligonucleotide
  Target: AGXT; (+) strand; PAM type: NRG; PAM sequence: TGG
agatttacattggttccatc

SEQ ID NO: 10701 - DNA, 20 bp, Artificial Sequence
  Description of Artificial Sequence: Synthetic oligonucleotide
  Target: AGXT; (+) strand; PAM type: NRG; PAM sequence: AAG
tttacattggttccatctgg

SEQ ID NO: 10702 - DNA, 20 bp, Artificial Sequence
  Description of Artificial Sequence: Synthetic oligonucleotide
  Target: AGXT; (+) strand; PAM type: NRG; PAM sequence: AGG
ttacattggttccatctgga

SEQ ID NO: 10703 - DNA, 20 bp, Artificial Sequence
  Description of Artificial Sequence: Synthetic oligonucleotide
  Target: AGXT; (+) strand; PAM type: NRG; PAM sequence: GGG
tacattggttccatctggaa

SEQ ID NO: 10704 - DNA, 20 bp, Artificial Sequence
  Description of Artificial Sequence: Synthetic oligonucleotide
  Target: AGXT; (+) strand; PAM type: NRG; PAM sequence: CGG
attggttccatctggaaggg

SEQ ID NO: 10705 - DNA, 20 bp, Artificial Sequence
  Description of Artificial Sequence: Synthetic oligonucleotide
  Target: AGXT; (+) strand; PAM type: NRG; PAM sequence: GGG
ttggttccatctggaagggc

SEQ ID NO: 10706 - DNA, 20 bp, Artificial Sequence
  Description of Artificial Sequence: Synthetic oligonucleotide
  Target: AGXT; (+) strand; PAM type: NRG; PAM sequence: TGG
aagggcgggacaacttgaat

SEQ ID NO: 10707 - DNA, 20 bp, Artificial Sequence
  Description of Artificial Sequence: Synthetic oligonucleotide
  Target: AGXT; (+) strand; PAM type: NRG; PAM sequence: GGG
agggcgggacaacttgaatt

SEQ ID NO: 10708 - DNA, 20 bp, Artificial Sequence
  Description of Artificial Sequence: Synthetic oligonucleotide
  Target: AGXT; (+) strand; PAM type: NRG; PAM sequence: GGG
gggcgggacaacttgaattg

SEQ ID NO: 10709 - DNA, 20 bp, Artificial Sequence
  Description of Artificial Sequence: Synthetic oligonucleotide
  Target: AGXT; (+) strand; PAM type: NRG; PAM sequence: GGG
ggcgggacaacttgaattgg

SEQ ID NO: 10710 - DNA, 20 bp, Artificial Sequence
  Description of Artificial Sequence: Synthetic oligonucleotide
  Target: AGXT; (+) strand; PAM type: NRG; PAM sequence: GGG
gcgggacaacttgaattggg

SEQ ID NO: 10711 - DNA, 20 bp, Artificial Sequence
  Description of Artificial Sequence: Synthetic oligonucleotide
  Target: AGXT; (+) strand; PAM type: NRG; PAM sequence: CAG
aacttgaattggggggcttc

SEQ ID NO: 10712 - DNA, 20 bp, Artificial Sequence
  Description of Artificial Sequence: Synthetic oligonucleotide
  Target: AGXT; (+) strand; PAM type: NRG; PAM sequence: AGG
acttgaattggggggcttcc

SEQ ID NO: 10713 - DNA, 20 bp, Artificial Sequence
  Description of Artificial Sequence: Synthetic oligonucleotide
  Target: AGXT; (+) strand; PAM type: NRG; PAM sequence: TAG
attggggggcttccaggtca

SEQ ID NO: 10714 - DNA, 20 bp, Artificial Sequence
  Description of Artificial Sequence: Synthetic oligonucleotide
  Target: AGXT; (+) strand; PAM type: NRG; PAM sequence: AGG
ttggggggcttccaggtcat

SEQ ID NO: 10715 - DNA, 20 bp, Artificial Sequence
  Description of Artificial Sequence: Synthetic oligonucleotide
  Target: AGXT; (+) strand; PAM type: NRG; PAM sequence: TAG
gggggcttccaggtcatagg

SEQ ID NO: 10716 - DNA, 20 bp, Artificial Sequence
  Description of Artificial Sequence: Synthetic oligonucleotide
  Target: AGXT; (+) strand; PAM type: NRG; PAM sequence: TGG
agatttaaacatattttgat

SEQ ID NO: 10717 - DNA, 20 bp, Artificial Sequence
  Description of Artificial Sequence: Synthetic oligonucleotide
  Target: AGXT; (+) strand; PAM type: NRG; PAM sequence: AAG
ttttgattggcaactgactg

SEQ ID NO: 10718 - DNA, 20 bp, Artificial Sequence
  Description of Artificial Sequence: Synthetic oligonucleotide
  Target: AGXT; (+) strand; PAM type: NRG; PAM sequence: CAG
actgactgaagaattattat

SEQ ID NO: 10719 - DNA, 20 bp, Artificial Sequence
  Description of Artificial Sequence: Synthetic oligonucleotide
  Target: AGXT; (+) strand; PAM type: NRG; PAM sequence: CAG
gactgaagaattattatcag

SEQ ID NO: 10720 - DNA, 20 bp, Artificial Sequence
  Description of Artificial Sequence: Synthetic oligonucleotide
  Target: AGXT; (+) strand; PAM type: NRG; PAM sequence: AAG
gaagaattattatcagcaga

SEQ ID NO: 10721 - DNA, 20 bp, Artificial Sequence
  Description of Artificial Sequence: Synthetic oligonucleotide
  Target: AGXT; (+) strand; PAM type: NRG; PAM sequence: AGG
aagaattattatcagcagaa

SEQ ID NO: 10722 - DNA, 20 bp, Artificial Sequence
  Description of Artificial Sequence: Synthetic oligonucleotide
  Target: AGXT; (+) strand; PAM type: NRG; PAM sequence: GAG
gaattattatcagcagaaag

SEQ ID NO: 10723 - DNA, 20 bp, Artificial Sequence
  Description of Artificial Sequence: Synthetic oligonucleotide
  Target: AGXT; (+) strand; PAM type: NRG; PAM sequence: TGG
tatcagcagaaaggagtgtc

SEQ ID NO: 10724 - DNA, 20 bp, Artificial Sequence
  Description of Artificial Sequence: Synthetic oligonucleotide
  Target: AGXT; (+) strand; PAM type: NRG; PAM sequence: GGG
atcagcagaaaggagtgtct

SEQ ID NO: 10725 - DNA, 20 bp, Artificial Sequence
  Description of Artificial Sequence: Synthetic oligonucleotide
  Target: AGXT; (+) strand; PAM type: NRG; PAM sequence: TAG
ggagtgtctgggttatgaaa

SEQ ID NO: 10726 - DNA, 20 bp, Artificial Sequence
  Description of Artificial Sequence: Synthetic oligonucleotide
  Target: AGXT; (+) strand; PAM type: NRG; PAM sequence: AGG
gagtgtctgggttatgaaat

SEQ ID NO: 10727 - DNA, 20 bp, Artificial Sequence
  Description of Artificial Sequence: Synthetic oligonucleotide
  Target: AGXT; (+) strand; PAM type: NRG; PAM sequence: GGG
agtgtctgggttatgaaata

SEQ ID NO: 10728 - DNA, 20 bp, Artificial Sequence
  Description of Artificial Sequence: Synthetic oligonucleotide
  Target: AGXT; (+) strand; PAM type: NRG; PAM sequence: GGG
gtgtctgggttatgaaatag

SEQ ID NO: 10729 - DNA, 20 bp, Artificial Sequence
  Description of Artificial Sequence: Synthetic oligonucleotide
  Target: AGXT; (+) strand; PAM type: NRG; PAM sequence: CAG
gggttatgaaataggggttg

SEQ ID NO: 10730 - DNA, 20 bp, Artificial Sequence
  Description of Artificial Sequence: Synthetic oligonucleotide
  Target: AGXT; (+) strand; PAM type: NRG; PAM sequence: AGG
ggttatgaaataggggttgc

SEQ ID NO: 10731 - DNA, 20 bp, Artificial Sequence
  Description of Artificial Sequence: Synthetic oligonucleotide
  Target: AGXT; (+) strand; PAM type: NRG; PAM sequence: GGG
gttatgaaataggggttgca

SEQ ID NO: 10732 - DNA, 20 bp, Artificial Sequence
  Description of Artificial Sequence: Synthetic oligonucleotide
  Target: AGXT; (+) strand; PAM type: NRG; PAM sequence: GAG
tatgaaataggggttgcagg

SEQ ID NO: 10733 - DNA, 20 bp, Artificial Sequence
  Description of Artificial Sequence: Synthetic oligonucleotide
  Target: AGXT; (+) strand; PAM type: NRG; PAM sequence: CAG
gaaataggggttgcagggag

SEQ ID NO: 10734 - DNA, 20 bp, Artificial Sequence
  Description of Artificial Sequence: Synthetic oligonucleotide
  Target: AGXT; (+) strand; PAM type: NRG; PAM sequence: CAG
cagggagcagatgatgcctt

SEQ ID NO: 10735 - DNA, 20 bp, Artificial Sequence
  Description of Artificial Sequence: Synthetic oligonucleotide
  Target: AGXT; (+) strand; PAM type: NRG; PAM sequence: AGG
agggagcagatgatgccttc

SEQ ID NO: 10736 - DNA, 20 bp, Artificial Sequence
  Description of Artificial Sequence: Synthetic oligonucleotide
  Target: AGXT; (+) strand; PAM type: NRG; PAM sequence: TAG
gagcagatgatgccttcagg

SEQ ID NO: 10737 - DNA, 20 bp, Artificial Sequence
  Description of Artificial Sequence: Synthetic oligonucleotide
  Target: AGXT; (+) strand; PAM type: NRG; PAM sequence: CGG
cagatgatgccttcaggtag

SEQ ID NO: 10738 - DNA, 20 bp, Artificial Sequence
  Description of Artificial Sequence: Synthetic oligonucleotide
  Target: AGXT; (+) strand; PAM type: NRG; PAM sequence: GGG
agatgatgccttcaggtagc

SEQ ID NO: 10739 - DNA, 20 bp, Artificial Sequence
  Description of Artificial Sequence: Synthetic oligonucleotide
  Target: AGXT; (+) strand; PAM type: NRG; PAM sequence: TAG
tgccttcaggtagcgggatt

SEQ ID NO: 10740 - DNA, 20 bp, Artificial Sequence
  Description of Artificial Sequence: Synthetic oligonucleotide
  Target: AGXT; (+) strand; PAM type: NRG; PAM sequence: GAG
ccttcaggtagcgggattta

SEQ ID NO: 10741 - DNA, 20 bp, Artificial Sequence
  Description of Artificial Sequence: Synthetic oligonucleotide
  Target: AGXT; (+) strand; PAM type: NRG; PAM sequence: GAG
ttcaggtagcgggatttaga

SEQ ID NO: 10742 - DNA, 20 bp, Artificial Sequence
  Description of Artificial Sequence: Synthetic oligonucleotide
  Target: AGXT; (+) strand; PAM type: NRG; PAM sequence: TAG
agcgggatttagagagaaaa

SEQ ID NO: 10743 - DNA, 20 bp, Artificial Sequence
  Description of Artificial Sequence: Synthetic oligonucleotide
  Target: AGXT; (+) strand; PAM type: NRG; PAM sequence: TGG
ggatttagagagaaaataga

SEQ ID NO: 10744 - DNA, 20 bp, Artificial Sequence
  Description of Artificial Sequence: Synthetic oligonucleotide
  Target: AGXT; (+) strand; PAM type: NRG; PAM sequence: CAG
agatggtaaatgcttcctat

SEQ ID NO: 10745 - DNA, 20 bp, Artificial Sequence
  Description of Artificial Sequence: Synthetic oligonucleotide
  Target: AGXT; (+) strand; PAM type: NRG; PAM sequence: AAG
aaatgcttcctatcagactt

SEQ ID NO: 10746 - DNA, 20 bp, Artificial Sequence
  Description of Artificial Sequence: Synthetic oligonucleotide
  Target: AGXT; (+) strand; PAM type: NRG; PAM sequence: AGG
aatgcttcctatcagactta

SEQ ID NO: 10747 - DNA, 20 bp, Artificial Sequence
  Description of Artificial Sequence: Synthetic oligonucleotide
  Target: AGXT; (+) strand; PAM type: NRG; PAM sequence: TGG
gtctatgtcgatgttaatgc

SEQ ID NO: 10748 - DNA, 20 bp, Artificial Sequence
  Description of Artificial Sequence: Synthetic oligonucleotide
  Target: AGXT; (+) strand; PAM type: NRG; PAM sequence: GGG
tctatgtcgatgttaatgct

SEQ ID NO: 10749 - DNA, 20 bp, Artificial Sequence
  Description of Artificial Sequence: Synthetic oligonucleotide
  Target: AGXT; (+) strand; PAM type: NRG; PAM sequence: GGG
ctatgtcgatgttaatgctg

SEQ ID NO: 10750 - DNA, 20 bp, Artificial Sequence
  Description of Artificial Sequence: Synthetic oligonucleotide
  Target: AGXT; (+) strand; PAM type: NRG; PAM sequence: GGG
tatgtcgatgttaatgctgg

SEQ ID NO: 10751 - DNA, 20 bp, Artificial Sequence
  Description of Artificial Sequence: Synthetic oligonucleotide
  Target: AGXT; (+) strand; PAM type: NRG; PAM sequence: TGG
taatgctgggggttatgatg

SEQ ID NO: 10752 - DNA, 20 bp, Artificial Sequence
  Description of Artificial Sequence: Synthetic oligonucleotide
  Target: AGXT; (+) strand; PAM type: NRG; PAM sequence: TGG
ctgggggttatgatgtggca

SEQ ID NO: 10753 - DNA, 20 bp, Artificial Sequence
  Description of Artificial Sequence: Synthetic oligonucleotide
  Target: AGXT; (+) strand; PAM type: NRG; PAM sequence: CGG
ggcatggcctgaacgtcttc

SEQ ID NO: 10754 - DNA, 20 bp, Artificial Sequence
  Description of Artificial Sequence: Synthetic oligonucleotide
  Target: AGXT; (+) strand; PAM type: NRG; PAM sequence: GGG
gcatggcctgaacgtcttcc

SEQ ID NO: 10755 - DNA, 20 bp, Artificial Sequence
  Description of Artificial Sequence: Synthetic oligonucleotide
  Target: AGXT; (+) strand; PAM type: NRG; PAM sequence: AAG
cctgaacgtcttccgggtta

SEQ ID NO: 10756 - DNA, 20 bp, Artificial Sequence
  Description of Artificial Sequence: Synthetic oligonucleotide
  Target: AGXT; (+) strand; PAM type: NRG; PAM sequence: TAG
acgtcttccgggttaaagtt

SEQ ID NO: 10757 - DNA, 20 bp, Artificial Sequence
  Description of Artificial Sequence: Synthetic oligonucleotide
  Target: AGXT; (+) strand; PAM type: NRG; PAM sequence: GAG
gtcttccgggttaaagttta

SEQ ID NO: 10758 - DNA, 20 bp, Artificial Sequence
  Description of Artificial Sequence: Synthetic oligonucleotide
  Target: AGXT; (+) strand; PAM type: NRG; PAM sequence: TGG
ggttaaagtttagagcaccc

SEQ ID NO: 10759 - DNA, 20 bp, Artificial Sequence
  Description of Artificial Sequence: Synthetic oligonucleotide
  Target: AGXT; (+) strand; PAM type: NRG; PAM sequence: CGG
taaagtttagagcaccctgg

SEQ ID NO: 10760 - DNA, 20 bp, Artificial Sequence
  Description of Artificial Sequence: Synthetic oligonucleotide
  Target: AGXT; (+) strand; PAM type: NRG; PAM sequence: CAG
gtttagagcaccctggcgga

SEQ ID NO: 10761 - DNA, 20 bp, Artificial Sequence
  Description of Artificial Sequence: Synthetic oligonucleotide
  Target: AGXT; (+) strand; PAM type: NRG; PAM sequence: AGG
tttagagcaccctggcggac

SEQ ID NO: 10762 - DNA, 20 bp, Artificial Sequence
  Description of Artificial Sequence: Synthetic oligonucleotide
  Target: AGXT; (+) strand; PAM type: NRG; PAM sequence: GGG
ttagagcaccctggcggaca

SEQ ID NO: 10763 - DNA, 20 bp, Artificial Sequence
  Description of Artificial Sequence: Synthetic oligonucleotide
  Target: AGXT; (+) strand; PAM type: NRG; PAM sequence: CAG
ggcggacagggaaccccatt

SEQ ID NO: 10764 - DNA, 20 bp, Artificial Sequence
  Description of Artificial Sequence: Synthetic oligonucleotide
  Target: AGXT; (+) strand; PAM type: NRG; PAM sequence: TGG
gacagggaaccccattcaga

SEQ ID NO: 10765 - DNA, 20 bp, Artificial Sequence
  Description of Artificial Sequence: Synthetic oligonucleotide
  Target: AGXT; (+) strand; PAM type: NRG; PAM sequence: TGG
aaccccattcagatggttgc

SEQ ID NO: 10766 - DNA, 20 bp, Artificial Sequence
  Description of Artificial Sequence: Synthetic oligonucleotide
  Target: AGXT; (+) strand; PAM type: NRG; PAM sequence: GGG
accccattcagatggttgct

SEQ ID NO: 10767 - DNA, 20 bp, Artificial Sequence
  Description of Artificial Sequence: Synthetic oligonucleotide
  Target: AGXT; (+) strand; PAM type: NRG; PAM sequence: GGG
ccccattcagatggttgctg

SEQ ID NO: 10768 - DNA, 20 bp, Artificial Sequence
  Description of Artificial Sequence: Synthetic oligonucleotide
  Target: AGXT; (+) strand; PAM type: NRG; PAM sequence: GGG
cccattcagatggttgctgg

SEQ ID NO: 10769 - DNA, 20 bp, Artificial Sequence
  Description of Artificial Sequence: Synthetic oligonucleotide
  Target: AGXT; (+) strand; PAM type: NRG; PAM sequence: GGG
ccattcagatggttgctggg

SEQ ID NO: 10770 - DNA, 20 bp, Artificial Sequence
  Description of Artificial Sequence: Synthetic oligonucleotide
  Target: AGXT; (+) strand; PAM type: NRG; PAM sequence: TGG
gggccttcgaattttatttt

SEQ ID NO: 10771 - DNA, 20 bp, Artificial Sequence
  Description of Artificial Sequence: Synthetic oligonucleotide
  Target: AGXT; (+) strand; PAM type: NRG; PAM sequence: AAG
gaattttatttttggtttac

SEQ ID NO: 10772 - DNA, 20 bp, Artificial Sequence
  Description of Artificial Sequence: Synthetic oligonucleotide
  Target: AGXT; (+) strand; PAM type: NRG; PAM sequence: CAG
tggtttacaagccttcccat

SEQ ID NO: 10773 - DNA, 20 bp, Artificial Sequence
  Description of Artificial Sequence: Synthetic oligonucleotide
  Target: AGXT; (+) strand; PAM type: NRG; PAM sequence: CAG
agccttcccatcagctgcgc

SEQ ID NO: 10774 - DNA, 20 bp, Artificial Sequence
  Description of Artificial Sequence: Synthetic oligonucleotide
  Target: AGXT; (+) strand; PAM type: NRG; PAM sequence: AGG
gccttcccatcagctgcgcc

SEQ ID NO: 10775 - DNA, 20 bp, Artificial Sequence
  Description of Artificial Sequence: Synthetic oligonucleotide
  Target: AGXT; (+) strand; PAM type: NRG; PAM sequence: GGG
ccttcccatcagctgcgcca

SEQ ID NO: 10776 - DNA, 20 bp, Artificial Sequence
  Description of Artificial Sequence: Synthetic oligonucleotide
  Target: AGXT; (+) strand; PAM type: NRG; PAM sequence: CAG
cccatcagctgcgccagggt

SEQ ID NO: 10777 - DNA, 20 bp, Artificial Sequence
  Description of Artificial Sequence: Synthetic oligonucleotide
  Target: AGXT; (+) strand; PAM type: NRG; PAM sequence: CAG
gcgccagggtcagcaaacca

SEQ ID NO: 10778 - DNA, 20 bp, Artificial Sequence
  Description of Artificial Sequence: Synthetic oligonucleotide
  Target: AGXT; (+) strand; PAM type: NRG; PAM sequence: TGG
ggtcagcaaaccacagtcca

SEQ ID NO: 10779 - DNA, 20 bp, Artificial Sequence
  Description of Artificial Sequence: Synthetic oligonucleotide
  Target: AGXT; (+) strand; PAM type: NRG; PAM sequence: GGG
gtcagcaaaccacagtccat

SEQ ID NO: 10780 - DNA, 20 bp, Artificial Sequence
  Description of Artificial Sequence: Synthetic oligonucleotide
  Target: AGXT; (+) strand; PAM type: NRG; PAM sequence: TGG
cacagtccatgggcccaatc

SEQ ID NO: 10781 - DNA, 20 bp, Artificial Sequence
  Description of Artificial Sequence: Synthetic oligonucleotide
  Target: AGXT; (+) strand; PAM type: NRG; PAM sequence: AAG
ccacctgctttttgtaaata

SEQ ID NO: 10782 - DNA, 20 bp, Artificial Sequence
  Description of Artificial Sequence: Synthetic oligonucleotide
  Target: AGXT; (+) strand; PAM type: NRG; PAM sequence: TAG
tttttgtaaataaagtttta

SEQ ID NO: 10783 - DNA, 20 bp, Artificial Sequence
  Description of Artificial Sequence: Synthetic oligonucleotide
  Target: AGXT; (+) strand; PAM type: NRG; PAM sequence: AGG
ttttgtaaataaagttttat

SEQ ID NO: 10784 - DNA, 20 bp, Artificial Sequence
  Description of Artificial Sequence: Synthetic oligonucleotide
  Target: AGXT; (+) strand; PAM type: NRG; PAM sequence: TGG
taggaacacgcccacacctc

SEQ ID NO: 10785 - DNA, 20 bp, Artificial Sequence
  Description of Artificial Sequence: Synthetic oligonucleotide
  Target: AGXT; (+) strand; PAM type: NRG; PAM sequence: CAG
gaacacgcccacacctctgg

SEQ ID NO: 10786 - DNA, 20 bp, Artificial Sequence
  Description of Artificial Sequence: Synthetic oligonucleotide
  Target: AGXT; (+) strand; PAM type: NRG; PAM sequence: AAG
acctctggcagctgctttgc

SEQ ID NO: 10787 - DNA, 20 bp, Artificial Sequence
  Description of Artificial Sequence: Synthetic oligonucleotide
  Target: AGXT; (+) strand; PAM type: NRG; PAM sequence: CAG
gcagctgctttgcaagcacg

SEQ ID NO: 10788 - DNA, 20 bp, Artificial Sequence
  Description of Artificial Sequence: Synthetic oligonucleotide
  Target: AGXT; (+) strand; PAM type: NRG; PAM sequence: CAG
gctgctttgcaagcacgcag

SEQ ID NO: 10789 - DNA, 20 bp, Artificial Sequence
  Description of Artificial Sequence: Synthetic oligonucleotide
  Target: AGXT; (+) strand; PAM type: NRG; PAM sequence: AGG
ctgctttgcaagcacgcagc

SEQ ID NO: 10790 - DNA, 20 bp, Artificial Sequence
  Description of Artificial Sequence: Synthetic oligonucleotide
  Target: AGXT; (+) strand; PAM type: NRG; PAM sequence: GGG
tgctttgcaagcacgcagca

SEQ ID NO: 10791 - DNA, 20 bp, Artificial Sequence
  Description of Artificial Sequence: Synthetic oligonucleotide
  Target: AGXT; (+) strand; PAM type: NRG; PAM sequence: GAG
tgcaagcacgcagcagggtt

SEQ ID NO: 10792 - DNA, 20 bp, Artificial Sequence
  Description of Artificial Sequence: Synthetic oligonucleotide
  Target: AGXT; (+) strand; PAM type: NRG; PAM sequence: TAG
agggttgagttgttgcaaca

SEQ ID NO: 10793 - DNA, 20 bp, Artificial Sequence
  Description of Artificial Sequence: Synthetic oligonucleotide
  Target: AGXT; (+) strand; PAM type: NRG; PAM sequence: CAG
agttgttgcaacatagacca

SEQ ID NO: 10794 - DNA, 20 bp, Artificial Sequence
  Description of Artificial Sequence: Synthetic oligonucleotide
  Target: AGXT; (+) strand; PAM type: NRG; PAM sequence: AGG
gttgttgcaacatagaccac

SEQ ID NO: 10795 - DNA, 20 bp, Artificial Sequence
  Description of Artificial Sequence: Synthetic oligonucleotide
  Target: AGXT; (+) strand; PAM type: NRG; PAM sequence: GGG
ttgttgcaacatagaccaca

SEQ ID NO: 10796 - DNA, 20 bp, Artificial Sequence
  Description of Artificial Sequence: Synthetic oligonucleotide
  Target: AGXT; (+) strand; PAM type: NRG; PAM sequence: AAG
catagaccacagggcctgcc

SEQ ID NO: 10797 - DNA, 20 bp, Artificial Sequence
  Description of Artificial Sequence: Synthetic oligonucleotide
  Target: AGXT; (+) strand; PAM type: NRG; PAM sequence: AAG
tatctgtgctccgacccttt

SEQ ID NO: 10798 - DNA, 20 bp, Artificial Sequence
  Description of Artificial Sequence: Synthetic oligonucleotide
  Target: AGXT; (+) strand; PAM type: NRG; PAM sequence: GAG
gaaacacttctctcacccct

SEQ ID NO: 10799 - DNA, 20 bp, Artificial Sequence
  Description of Artificial Sequence: Synthetic oligonucleotide
  Target: AGXT; (+) strand; PAM type: NRG; PAM sequence: AAG
acttctctcacccctgagct

SEQ ID NO: 10800 - DNA, 20 bp, Artificial Sequence
  Description of Artificial Sequence: Synthetic oligonucleotide
  Target: AGXT; (+) strand; PAM type: NRG; PAM sequence: CAG
tctctcacccctgagctaag

SEQ ID NO: 10801 - DNA, 20 bp, Artificial Sequence
  Description of Artificial Sequence: Synthetic oligonucleotide
  Target: AGXT; (+) strand; PAM type: NRG; PAM sequence: AAG
acccctgagctaagcagaat

SEQ ID NO: 10802 - DNA, 20 bp, Artificial Sequence
  Description of Artificial Sequence: Synthetic oligonucleotide
  Target: AGXT; (+) strand; PAM type: NRG; PAM sequence: GAG
ccctgagctaagcagaataa

SEQ ID NO: 10803 - DNA, 20 bp, Artificial Sequence
  Description of Artificial Sequence: Synthetic oligonucleotide
  Target: AGXT; (+) strand; PAM type: NRG; PAM sequence: AGG
cctgagctaagcagaataag

SEQ ID NO: 10804 - DNA, 20 bp, Artificial Sequence
  Description of Artificial Sequence: Synthetic oligonucleotide
  Target: AGXT; (+) strand; PAM type: NRG; PAM sequence: GGG
ctgagctaagcagaataaga

SEQ ID NO: 10805 - DNA, 20 bp, Artificial Sequence
  Description of Artificial Sequence: Synthetic oligonucleotide
  Target: AGXT; (+) strand; PAM type: NRG; PAM sequence: GGG
tgagctaagcagaataagag

SEQ ID NO: 10806 - DNA, 20 bp, Artificial Sequence
  Description of Artificial Sequence: Synthetic oligonucleotide
  Target: AGXT; (+) strand; PAM type: NRG; PAM sequence: TGG
ctaagcagaataagaggggc

SEQ ID NO: 10807 - DNA, 20 bp, Artificial Sequence
  Description of Artificial Sequence: Synthetic oligonucleotide
  Target: AGXT; (+) strand; PAM type: NRG; PAM sequence: CAG
aataagaggggctggacgtg

SEQ ID NO: 10808 - DNA, 20 bp, Artificial Sequence
  Description of Artificial Sequence: Synthetic oligonucleotide
  Target: AGXT; (+) strand; PAM type: NRG; PAM sequence: AGG
ataagaggggctggacgtgc

SEQ ID NO: 10809 - DNA, 20 bp, Artificial Sequence
  Description of Artificial Sequence: Synthetic oligonucleotide
  Target: AGXT; (+) strand; PAM type: NRG; PAM sequence: CAG
ggggctggacgtgcaggact

SEQ ID NO: 10810 - DNA, 20 bp, Artificial Sequence
  Description of Artificial Sequence: Synthetic oligonucleotide
  Target: AGXT; (+) strand; PAM type: NRG; PAM sequence: GAG
ggctggacgtgcaggactca

SEQ ID NO: 10811 - DNA, 20 bp, Artificial Sequence
  Description of Artificial Sequence: Synthetic oligonucleotide
  Target: AGXT; (+) strand; PAM type: NRG; PAM sequence: TGG
tggacgtgcaggactcagag

SEQ ID NO: 10812 - DNA, 20 bp, Artificial Sequence
  Description of Artificial Sequence: Synthetic oligonucleotide
  Target: AGXT; (+) strand; PAM type: NRG; PAM sequence: GGG
ggacgtgcaggactcagagt

SEQ ID NO: 10813 - DNA, 20 bp, Artificial Sequence
  Description of Artificial Sequence: Synthetic oligonucleotide
  Target: AGXT; (+) strand; PAM type: NRG; PAM sequence: GAG
acgtgcaggactcagagtgg

SEQ ID NO: 10814 - DNA, 20 bp, Artificial Sequence
  Description of Artificial Sequence: Synthetic oligonucleotide
  Target: AGXT; (+) strand; PAM type: NRG; PAM sequence: GAG
gcaggactcagagtgggagc

SEQ ID NO: 10815 - DNA, 20 bp, Artificial Sequence
  Description of Artificial Sequence: Synthetic oligonucleotide
  Target: AGXT; (+) strand; PAM type: NRG; PAM sequence: AGG
caggactcagagtgggagcg

SEQ ID NO: 10816 - DNA, 20 bp, Artificial Sequence
  Description of Artificial Sequence: Synthetic oligonucleotide
  Target: AGXT; (+) strand; PAM type: NRG; PAM sequence: GAG
ggactcagagtgggagcgag

SEQ ID NO: 10817 - DNA, 20 bp, Artificial Sequence
  Description of Artificial Sequence: Synthetic oligonucleotide
  Target: AGXT; (+) strand; PAM type: NRG; PAM sequence: AGG
gactcagagtgggagcgagg

SEQ ID NO: 10818 - DNA, 20 bp, Artificial Sequence
  Description of Artificial Sequence: Synthetic oligonucleotide
  Target: AGXT; (+) strand; PAM type: NRG; PAM sequence: GGG
actcagagtgggagcgagga

SEQ ID NO: 10819 - DNA, 20 bp, Artificial Sequence
  Description of Artificial Sequence: Synthetic oligonucleotide
  Target: AGXT; (+) strand; PAM type: NRG; PAM sequence: TGG
agagtgggagcgaggagggc

SEQ ID NO: 10820 - DNA, 20 bp, Artificial Sequence
  Description of Artificial Sequence: Synthetic oligonucleotide
  Target: AGXT; (+) strand; PAM type: NRG; PAM sequence: GGG
gagtgggagcgaggagggct

SEQ ID NO: 10821 - DNA, 20 bp, Artificial Sequence
  Description of Artificial Sequence: Synthetic oligonucleotide
  Target: AGXT; (+) strand; PAM type: NRG; PAM sequence: GGG
agtgggagcgaggagggctg

SEQ ID NO: 10822 - DNA, 20 bp, Artificial Sequence
  Description of Artificial Sequence: Synthetic oligonucleotide
  Target: AGXT; (+) strand; PAM type: NRG; PAM sequence: GAG
ggagcgaggagggctggggt

SEQ ID NO: 10823 - DNA, 20 bp, Artificial Sequence
  Description of Artificial Sequence: Synthetic oligonucleotide
  Target: AGXT; (+) strand; PAM type: NRG; PAM sequence: AGG
gagcgaggagggctggggtg

SEQ ID NO: 10824 - DNA, 20 bp, Artificial Sequence
  Description of Artificial Sequence: Synthetic oligonucleotide
  Target: AGXT; (+) strand; PAM type: NRG; PAM sequence: CAG
gaggagggctggggtgagga

SEQ ID NO: 10825 - DNA, 20 bp, Artificial Sequence
  Description of Artificial Sequence: Synthetic oligonucleotide
  Target: AGXT; (+) strand; PAM type: NRG; PAM sequence: CAG
cactctgtttttctgtcact

SEQ ID NO: 10826 - DNA, 20 bp, Artificial Sequence
  Description of Artificial Sequence: Synthetic oligonucleotide
  Target: AGXT; (+) strand; PAM type: NRG; PAM sequence: TGG
gtttttctgtcactcagccc

SEQ ID NO: 10827 - DNA, 20 bp, Artificial Sequence
  Description of Artificial Sequence: Synthetic oligonucleotide
  Target: AGXT; (+) strand; PAM type: NRG; PAM sequence: GGG
tttttctgtcactcagccct

SEQ ID NO: 10828 - DNA, 20 bp, Artificial Sequence
  Description of Artificial Sequence: Synthetic oligonucleotide
  Target: AGXT; (+) strand; PAM type: NRG; PAM sequence: GGG
ttttctgtcactcagccctg

SEQ ID NO: 10829 - DNA, 20 bp, Artificial Sequence
  Description of Artificial Sequence: Synthetic oligonucleotide
  Target: AGXT; (+) strand; PAM type: NRG; PAM sequence: GGG
tttctgtcactcagccctgg

SEQ ID NO: 10830 - DNA, 20 bp, Artificial Sequence
  Description of Artificial Sequence: Synthetic oligonucleotide
  Target: AGXT; (+) strand; PAM type: NRG; PAM sequence: GAG
cctgggggctccctctgcct

SEQ ID NO: 10831 - DNA, 20 bp, Artificial Sequence
  Description of Artificial Sequence: Synthetic oligonucleotide
  Target: AGXT; (+) strand; PAM type: NRG; PAM sequence: AGG
ctgggggctccctctgcctg

SEQ ID NO: 10832 - DNA, 20 bp, Artificial Sequence
  Description of Artificial Sequence: Synthetic oligonucleotide
  Target: AGXT; (+) strand; PAM type: NRG; PAM sequence: GGG
tgggggctccctctgcctga

SEQ ID NO: 10833 - DNA, 20 bp, Artificial Sequence
  Description of Artificial Sequence: Synthetic oligonucleotide
  Target: AGXT; (+) strand; PAM type: NRG; PAM sequence: TGG
gggcttcgtcccctgctgcc

SEQ ID NO: 10834 - DNA, 20 bp, Artificial Sequence
  Description of Artificial Sequence: Synthetic oligonucleotide
  Target: AGXT; (+) strand; PAM type: NRG; PAM sequence: CAG
tgctgcctggccgtgacccg

SEQ ID NO: 10835 - DNA, 20 bp, Artificial Sequence
  Description of Artificial Sequence: Synthetic oligonucleotide
  Target: AGXT; (+) strand; PAM type: NRG; PAM sequence: AAG
ctggccgtgacccgcagcac

SEQ ID NO: 10836 - DNA, 20 bp, Artificial Sequence
  Description of Artificial Sequence: Synthetic oligonucleotide
  Target: AGXT; (+) strand; PAM type: NRG; PAM sequence: CAG
cgtgacccgcagcacaagca

SEQ ID NO: 10837 - DNA, 20 bp, Artificial Sequence
  Description of Artificial Sequence: Synthetic oligonucleotide
  Target: AGXT; (+) strand; PAM type: NRG; PAM sequence: AAG
cccgcagcacaagcacagat

SEQ ID NO: 10838 - DNA, 20 bp, Artificial Sequence
  Description of Artificial Sequence: Synthetic oligonucleotide
  Target: AGXT; (+) strand; PAM type: NRG; PAM sequence: CAG
gcacaagcacagataagcct

SEQ ID NO: 10839 - DNA, 20 bp, Artificial Sequence
  Description of Artificial Sequence: Synthetic oligonucleotide
  Target: AGXT; (+) strand; PAM type: NRG; PAM sequence: AGG
cacaagcacagataagcctc

SEQ ID NO: 10840 - DNA, 20 bp, Artificial Sequence
  Description of Artificial Sequence: Synthetic oligonucleotide
  Target: AGXT; (+) strand; PAM type: NRG; PAM sequence: GGG
acaagcacagataagcctca

SEQ ID NO: 10841 - DNA, 20 bp, Artificial Sequence
  Description of Artificial Sequence: Synthetic oligonucleotide
  Target: AGXT; (+) strand; PAM type: NRG; PAM sequence: AAG
agataagcctcagggaacaa

SEQ ID NO: 10842 - DNA, 20 bp, Artificial Sequence
  Description of Artificial Sequence: Synthetic oligonucleotide
  Target: AGXT; (+) strand; PAM type: NRG; PAM sequence: AGG
gataagcctcagggaacaaa

SEQ ID NO: 10843 - DNA, 20 bp, Artificial Sequence
  Description of Artificial Sequence: Synthetic oligonucleotide
  Target: AGXT; (+) strand; PAM type: NRG; PAM sequence: CAG
aagcctcagggaacaaaagg

SEQ ID NO: 10844 - DNA, 20 bp, Artificial Sequence
  Description of Artificial Sequence: Synthetic oligonucleotide
  Target: AGXT; (+) strand; PAM type: NRG; PAM sequence: AGG
agcctcagggaacaaaaggc

SEQ ID NO: 10845 - DNA, 20 bp, Artificial Sequence
  Description of Artificial Sequence: Synthetic oligonucleotide
  Target: AGXT; (+) strand; PAM type: NRG; PAM sequence: GGG
gcctcagggaacaaaaggca

SEQ ID NO: 10846 - DNA, 20 bp, Artificial Sequence
  Description of Artificial Sequence: Synthetic oligonucleotide
  Target: AGXT; (+) strand; PAM type: NRG; PAM sequence: CGG
aacaaaaggcagggctgcca

SEQ ID NO: 10847 - DNA, 20 bp, Artificial Sequence
  Description of Artificial Sequence: Synthetic oligonucleotide
  Target: AGXT; (+) strand; PAM type: NRG; PAM sequence: AAG
aaaaggcagggctgccacgg

SEQ ID NO: 10848 - DNA, 20 bp, Artificial Sequence
  Description of Artificial Sequence: Synthetic oligonucleotide
  Target: AGXT; (+) strand; PAM type: NRG; PAM sequence: TGG
cacctctgtgtccgccctgc

SEQ ID NO: 10849 - DNA, 20 bp, Artificial Sequence
  Description of Artificial Sequence: Synthetic oligonucleotide
  Target: AGXT; (+) strand; PAM type: NRG; PAM sequence: GGG
acctctgtgtccgccctgct

SEQ ID NO: 10850 - DNA, 20 bp, Artificial Sequence
  Description of Artificial Sequence: Synthetic oligonucleotide
  Target: AGXT; (+) strand; PAM type: NRG; PAM sequence: CAG
cgccctgctgggaaatattc

SEQ ID NO: 10851 - DNA, 20 bp, Artificial Sequence
  Description of Artificial Sequence: Synthetic oligonucleotide
  Target: AGXT; (+) strand; PAM type: NRG; PAM sequence: AGG
gccctgctgggaaatattcc

SEQ ID NO: 10852 - DNA, 20 bp, Artificial Sequence
  Description of Artificial Sequence: Synthetic oligonucleotide
  Target: AGXT; (+) strand; PAM type: NRG; PAM sequence: TGG
ctgggaaatattccaggctt

SEQ ID NO: 10853 - DNA, 20 bp, Artificial Sequence
  Description of Artificial Sequence: Synthetic oligonucleotide
  Target: AGXT; (+) strand; PAM type: NRG; PAM sequence: AAG
aaatattccaggctttggcc

SEQ ID NO: 10854 - DNA, 20 bp, Artificial Sequence
  Description of Artificial Sequence: Synthetic oligonucleotide
  Target: AGXT; (+) strand; PAM type: NRG; PAM sequence: AGG
aatattccaggctttggcca

SEQ ID NO: 10855 - DNA, 20 bp, Artificial Sequence
  Description of Artificial Sequence: Synthetic oligonucleotide
  Target: AGXT; (+) strand; PAM type: NRG; PAM sequence: CAG
ttccaggctttggccaaggc

SEQ ID NO: 10856 - DNA, 20 bp, Artificial Sequence
  Description of Artificial Sequence: Synthetic oligonucleotide
  Target: AGXT; (+) strand; PAM type: NRG; PAM sequence: CAG
ggctttggccaaggccagtg

SEQ ID NO: 10857 - DNA, 20 bp, Artificial Sequence
  Description of Artificial Sequence: Synthetic oligonucleotide
  Target: AGXT; (+) strand; PAM type: NRG; PAM sequence: CAG
ggccaaggccagtgcagccc

SEQ ID NO: 10858 - DNA, 20 bp, Artificial Sequence
  Description of Artificial Sequence: Synthetic oligonucleotide
  Target: AGXT; (+) strand; PAM type: NRG; PAM sequence: AGG
gccaaggccagtgcagcccc

SEQ ID NO: 10859 - DNA, 20 bp, Artificial Sequence
  Description of Artificial Sequence: Synthetic oligonucleotide
  Target: AGXT; (+) strand; PAM type: NRG; PAM sequence: GAG
cagtgcagccccaggttccc

SEQ ID NO: 10860 - DNA, 20 bp, Artificial Sequence
  Description of Artificial Sequence: Synthetic oligonucleotide
  Target: AGXT; (+) strand; PAM type: NRG; PAM sequence: CGG
tgcagccccaggttcccgag

SEQ ID NO: 10861 - DNA, 20 bp, Artificial Sequence
  Description of Artificial Sequence: Synthetic oligonucleotide
  Target: AGXT; (+) strand; PAM type: NRG; PAM sequence: CAG
agccccaggttcccgagcgg

SEQ ID NO: 10862 - DNA, 20 bp, Artificial Sequence
  Description of Artificial Sequence: Synthetic oligonucleotide
  Target: AGXT; (+) strand; PAM type: NRG; PAM sequence: AGG
gccccaggttcccgagcggc

SEQ ID NO: 10863 - DNA, 20 bp, Artificial Sequence
  Description of Artificial Sequence: Synthetic oligonucleotide
  Target: AGXT; (+) strand; PAM type: NRG; PAM sequence: TGG
caggttcccgagcggcaggt

SEQ ID NO: 10864 - DNA, 20 bp, Artificial Sequence
  Description of Artificial Sequence: Synthetic oligonucleotide
  Target: AGXT; (+) strand; PAM type: NRG; PAM sequence: GGG
aggttcccgagcggcaggtt

SEQ ID NO: 10865 - DNA, 20 bp, Artificial Sequence
  Description of Artificial Sequence: Synthetic oligonucleotide
  Target: AGXT; (+) strand; PAM type: NRG; PAM sequence: CGG
cccgagcggcaggttgggtg

SEQ ID NO: 10866 - DNA, 20 bp, Artificial Sequence
  Description of Artificial Sequence: Synthetic oligonucleotide
  Target: AGXT; (+) strand; PAM type: NRG; PAM sequence: TGG
ggcaggttgggtgcggacca

SEQ ID NO: 10867 - DNA, 20 bp, Artificial Sequence
  Description of Artificial Sequence: Synthetic oligonucleotide
  Target: AGXT; (+) strand; PAM type: NRG; PAM sequence: AAG
tgcggaccatggcctctcac

SEQ ID NO: 10868 - DNA, 20 bp, Artificial Sequence
  Description of Artificial Sequence: Synthetic oligonucleotide
  Target: AGXT; (+) strand; PAM type: NRG; PAM sequence: TGG
catggcctctcacaagctgc

SEQ ID NO: 10869 - DNA, 20 bp, Artificial Sequence
  Description of Artificial Sequence: Synthetic oligonucleotide
  Target: AGXT; (+) strand; PAM type: NRG; PAM sequence: AAG
agctgctggtgacccccccc

SEQ ID NO: 10870 - DNA, 20 bp, Artificial Sequence
  Description of Artificial Sequence: Synthetic oligonucleotide
  Target: AGXT; (+) strand; PAM type: NRG; PAM sequence: AGG
gctgctggtgacccccccca

SEQ ID NO: 10871 - DNA, 20 bp, Artificial Sequence
  Description of Artificial Sequence: Synthetic oligonucleotide
  Target: AGXT; (+) strand; PAM type: NRG; PAM sequence: AAG
ccccccccaaggccctgctc

SEQ ID NO: 10872 - DNA, 20 bp, Artificial Sequence
  Description of Artificial Sequence: Synthetic oligonucleotide
  Target: AGXT; (+) strand; PAM type: NRG; PAM sequence: CAG
agcccctctccatccccaac

SEQ ID NO: 10873 - DNA, 20 bp, Artificial Sequence
  Description of Artificial Sequence: Synthetic oligonucleotide
  Target: AGXT; (+) strand; PAM type: NRG; PAM sequence: TGG
catccccaaccagctcctgc

SEQ ID NO: 10874 - DNA, 20 bp, Artificial Sequence
  Description of Artificial Sequence: Synthetic oligonucleotide
  Target: AGXT; (+) strand; PAM type: NRG; PAM sequence: GGG
atccccaaccagctcctgct

SEQ ID NO: 10875 - DNA, 20 bp, Artificial Sequence
  Description of Artificial Sequence: Synthetic oligonucleotide
  Target: AGXT; (+) strand; PAM type: NRG; PAM sequence: GGG
tccccaaccagctcctgctg

SEQ ID NO: 10876 - DNA, 20 bp, Artificial Sequence
  Description of Artificial Sequence: Synthetic oligonucleotide
  Target: AGXT; (+) strand; PAM type: NRG; PAM sequence: TGG
aaccagctcctgctggggcc

SEQ ID NO: 10877 - DNA, 20 bp, Artificial Sequence
  Description of Artificial Sequence: Synthetic oligonucleotide
  Target: AGXT; (+) strand; PAM type: NRG; PAM sequence: TGG
caacctgcctcctcgcatca

SEQ ID NO: 10878 - DNA, 20 bp, Artificial Sequence
  Description of Artificial Sequence: Synthetic oligonucleotide
  Target: AGXT; (+) strand; PAM type: NRG; PAM sequence: CAG
cctgcctcctcgcatcatgg

SEQ ID NO: 10879 - DNA, 20 bp, Artificial Sequence
  Description of Artificial Sequence: Synthetic oligonucleotide
  Target: AGXT; (+) strand; PAM type: NRG; PAM sequence: CGG
cctcctcgcatcatggcagc

SEQ ID NO: 10880 - DNA, 20 bp, Artificial Sequence
  Description of Artificial Sequence: Synthetic oligonucleotide
  Target: AGXT; (+) strand; PAM type: NRG; PAM sequence: GGG
ctcctcgcatcatggcagcc

SEQ ID NO: 10881 - DNA, 20 bp, Artificial Sequence
  Description of Artificial Sequence: Synthetic oligonucleotide
  Target: AGXT; (+) strand; PAM type: NRG; PAM sequence: GGG
tcctcgcatcatggcagccg

SEQ ID NO: 10882 - DNA, 20 bp, Artificial Sequence
  Description of Artificial Sequence: Synthetic oligonucleotide
  Target: AGXT; (+) strand; PAM type: NRG; PAM sequence: GGG
cctcgcatcatggcagccgg

SEQ ID NO: 10883 - DNA, 20 bp, Artificial Sequence
  Description of Artificial Sequence: Synthetic oligonucleotide
  Target: AGXT; (+) strand; PAM type: NRG; PAM sequence: GGG
ctcgcatcatggcagccggg

SEQ ID NO: 10884 - DNA, 20 bp, Artificial Sequence
  Description of Artificial Sequence: Synthetic oligonucleotide
  Target: AGXT; (+) strand; PAM type: NRG; PAM sequence: CAG
tcatggcagccggggggctg

SEQ ID NO: 10885 - DNA, 20 bp, Artificial Sequence
  Description of Artificial Sequence: Synthetic oligonucleotide
  Target: AGXT; (+) strand; PAM type: NRG; PAM sequence: CGG
gccggggggctgcagatgat

SEQ ID NO: 10886 - DNA, 20 bp, Artificial Sequence
  Description of Artificial Sequence: Synthetic oligonucleotide
  Target: AGXT; (+) strand; PAM type: NRG; PAM sequence: GGG
ccggggggctgcagatgatc

SEQ ID NO: 10887 - DNA, 20 bp, Artificial Sequence
  Description of Artificial Sequence: Synthetic oligonucleotide
  Target: AGXT; (+) strand; PAM type: NRG; PAM sequence: GAG
ctgcagatgatcgggtccat

SEQ ID NO: 10888 - DNA, 20 bp, Artificial Sequence
  Description of Artificial Sequence: Synthetic oligonucleotide
  Target: AGXT; (+) strand; PAM type: NRG; PAM sequence: AAG
agatgatcgggtccatgagc

SEQ ID NO: 10889 - DNA, 20 bp, Artificial Sequence
  Description of Artificial Sequence: Synthetic oligonucleotide
  Target: AGXT; (+) strand; PAM type: NRG; PAM sequence: AGG
gatgatcgggtccatgagca

SEQ ID NO: 10890 - DNA, 20 bp, Artificial Sequence
  Description of Artificial Sequence: Synthetic oligonucleotide
  Target: AGXT; (+) strand; PAM type: NRG; PAM sequence: CAG
ccatgagcaaggatatgtac

SEQ ID NO: 10891 - DNA, 20 bp, Artificial Sequence
  Description of Artificial Sequence: Synthetic oligonucleotide
  Target: AGXT; (+) strand; PAM type: NRG; PAM sequence: AGG
catgagcaaggatatgtacc

SEQ ID NO: 10892 - DNA, 20 bp, Artificial Sequence
  Description of Artificial Sequence: Synthetic oligonucleotide
  Target: AGXT; (+) strand; PAM type: NRG; PAM sequence: TAG
gagcaaggatatgtaccagg

SEQ ID NO: 10893 - DNA, 20 bp, Artificial Sequence
  Description of Artificial Sequence: Synthetic oligonucleotide
  Target: AGXT; (+) strand; PAM type: NRG; PAM sequence: AGG
agcaaggatatgtaccaggt

SEQ ID NO: 10894 - DNA, 20 bp, Artificial Sequence
  Description of Artificial Sequence: Synthetic oligonucleotide
  Target: AGXT; (+) strand; PAM type: NRG; PAM sequence: GAG
caaggatatgtaccaggtag

SEQ ID NO: 10895 - DNA, 20 bp, Artificial Sequence
  Description of Artificial Sequence: Synthetic oligonucleotide
  Target: AGXT; (+) strand; PAM type: NRG; PAM sequence: TGG
ggatatgtaccaggtaggag

SEQ ID NO: 10896 - DNA, 20 bp, Artificial Sequence
  Description of Artificial Sequence: Synthetic oligonucleotide
  Target: AGXT; (+) strand; PAM type: NRG; PAM sequence: GGG
gatatgtaccaggtaggagt

SEQ ID NO: 10897 - DNA, 20 bp, Artificial Sequence
  Description of Artificial Sequence: Synthetic oligonucleotide
  Target: AGXT; (+) strand; PAM type: NRG; PAM sequence: GGG
atatgtaccaggtaggagtg

SEQ ID NO: 10898 - DNA, 20 bp, Artificial Sequence
  Description of Artificial Sequence: Synthetic oligonucleotide
  Target: AGXT; (+) strand; PAM type: NRG; PAM sequence: GGG
tatgtaccaggtaggagtgg

SEQ ID NO: 10899 - DNA, 20 bp, Artificial Sequence
  Description of Artificial Sequence: Synthetic oligonucleotide
  Target: AGXT; (+) strand; PAM type: NRG; PAM sequence: CGG
aggtaggagtgggggtcact

SEQ ID NO: 10900 - DNA, 20 bp, Artificial Sequence
  Description of Artificial Sequence: Synthetic oligonucleotide
  Target: AGXT; (+) strand; PAM type: NRG; PAM sequence: GGG
ggtaggagtgggggtcactc

SEQ ID NO: 10901 - DNA, 20 bp, Artificial Sequence
  Description of Artificial Sequence: Synthetic oligonucleotide
  Target: AGXT; (+) strand; PAM type: NRG; PAM sequence: GGG
gtaggagtgggggtcactcg

SEQ ID NO: 10902 - DNA, 20 bp, Artificial Sequence
  Description of Artificial Sequence: Synthetic oligonucleotide
  Target: AGXT; (+) strand; PAM type: NRG; PAM sequence: GGG
taggagtgggggtcactcgg

SEQ ID NO: 10903 - DNA, 20 bp, Artificial Sequence
  Description of Artificial Sequence: Synthetic oligonucleotide
  Target: AGXT; (+) strand; PAM type: NRG; PAM sequence: GGG
aggagtgggggtcactcggg

SEQ ID NO: 10904 - DNA, 20 bp, Artificial Sequence
  Description of Artificial Sequence: Synthetic oligonucleotide
  Target: AGXT; (+) strand; PAM type: NRG; PAM sequence: TGG
tgggggtcactcggggggcc

SEQ ID NO: 10905 - DNA, 20 bp, Artificial Sequence
  Description of Artificial Sequence: Synthetic oligonucleotide
  Target: AGXT; (+) strand; PAM type: NRG; PAM sequence: GGG
gggggtcactcggggggcct

SEQ ID NO: 10906 - DNA, 20 bp, Artificial Sequence
  Description of Artificial Sequence: Synthetic oligonucleotide
  Target: AGXT; (+) strand; PAM type: NRG; PAM sequence: CAG
ctcacccatgttcccaccca

SEQ ID NO: 10907 - DNA, 20 bp, Artificial Sequence
  Description of Artificial Sequence: Synthetic oligonucleotide
  Target: AGXT; (+) strand; PAM type: NRG; PAM sequence: TGG
atgttcccacccacagatcg

SEQ ID NO: 10908 - DNA, 20 bp, Artificial Sequence
  Description of Artificial Sequence: Synthetic oligonucleotide
  Target: AGXT; (+) strand; PAM type: NRG; PAM sequence: GAG
cccacccacagatcgtggac

SEQ ID NO: 10909 - DNA, 20 bp, Artificial Sequence
  Description of Artificial Sequence: Synthetic oligonucleotide
  Target: AGXT; (+) strand; PAM type: NRG; PAM sequence: AGG
ccacccacagatcgtggacg

SEQ ID NO: 10910 - DNA, 20 bp, Artificial Sequence
  Description of Artificial Sequence: Synthetic oligonucleotide
  Target: AGXT; (+) strand; PAM type: NRG; PAM sequence: GGG
cacccacagatcgtggacga

SEQ ID NO: 10911 - DNA, 20 bp, Artificial Sequence
  Description of Artificial Sequence: Synthetic oligonucleotide
  Target: AGXT; (+) strand; PAM type: NRG; PAM sequence: AAG
ccacagatcgtggacgaggg

SEQ ID NO: 10912 - DNA, 20 bp, Artificial Sequence
  Description of Artificial Sequence: Synthetic oligonucleotide
  Target: AGXT; (+) strand; PAM type: NRG; PAM sequence: AGG
cacagatcgtggacgaggga

SEQ ID NO: 10913 - DNA, 20 bp, Artificial Sequence
  Description of Artificial Sequence: Synthetic oligonucleotide
  Target: AGXT; (+) strand; PAM type: NRG; PAM sequence: GGG
acagatcgtggacgagggaa

SEQ ID NO: 10914 - DNA, 20 bp, Artificial Sequence
  Description of Artificial Sequence: Synthetic oligonucleotide
  Target: AGXT; (+) strand; PAM type: NRG; PAM sequence: GGG
cagatcgtggacgagggaag

SEQ ID NO: 10915 - DNA, 20 bp, Artificial Sequence
  Description of Artificial Sequence: Synthetic oligonucleotide
  Target: AGXT; (+) strand; PAM type: NRG; PAM sequence: GGG
agatcgtggacgagggaagg

SEQ ID NO: 10916 - DNA, 20 bp, Artificial Sequence
  Description of Artificial Sequence: Synthetic oligonucleotide
  Target: AGXT; (+) strand; PAM type: NRG; PAM sequence: TGG
ggggtcactgcctcctcact

SEQ ID NO: 10917 - DNA, 20 bp, Artificial Sequence
  Description of Artificial Sequence: Synthetic oligonucleotide
  Target: AGXT; (+) strand; PAM type: NRG; PAM sequence: GGG
gggtcactgcctcctcactt

SEQ ID NO: 10918 - DNA, 20 bp, Artificial Sequence
  Description of Artificial Sequence: Synthetic oligonucleotide
  Target: AGXT; (+) strand; PAM type: NRG; PAM sequence: GGG
ggtcactgcctcctcacttg

SEQ ID NO: 10919 - DNA, 20 bp, Artificial Sequence
  Description of Artificial Sequence: Synthetic oligonucleotide
  Target: AGXT; (+) strand; PAM type: NRG; PAM sequence: GAG
tcactgcctcctcacttggg

SEQ ID NO: 10920 - DNA, 20 bp, Artificial Sequence
  Description of Artificial Sequence: Synthetic oligonucleotide
  Target: AGXT; (+) strand; PAM type: NRG; PAM sequence: AGG
cactgcctcctcacttgggg

SEQ ID NO: 10921 - DNA, 20 bp, Artificial Sequence
  Description of Artificial Sequence: Synthetic oligonucleotide
  Target: AGXT; (+) strand; PAM type: NRG; PAM sequence: CGG
tgcctcctcacttggggagg

SEQ ID NO: 10922 - DNA, 20 bp, Artificial Sequence
  Description of Artificial Sequence: Synthetic oligonucleotide
  Target: AGXT; (+) strand; PAM type: NRG; PAM sequence: GGG
gcctcctcacttggggaggc

SEQ ID NO: 10923 - DNA, 20 bp, Artificial Sequence
  Description of Artificial Sequence: Synthetic oligonucleotide
  Target: AGXT; (+) strand; PAM type: NRG; PAM sequence: GGG
cctcctcacttggggaggcg

SEQ ID NO: 10924 - DNA, 20 bp, Artificial Sequence
  Description of Artificial Sequence: Synthetic oligonucleotide
  Target: AGXT; (+) strand; PAM type: NRG; PAM sequence: GAG
tcctcacttggggaggcggg

SEQ ID NO: 10925 - DNA, 20 bp, Artificial Sequence
  Description of Artificial Sequence: Synthetic oligonucleotide
  Target: AGXT; (+) strand; PAM type: NRG; PAM sequence: TGG
acttggggaggcggggagcc

SEQ ID NO: 10926 - DNA, 20 bp, Artificial Sequence
  Description of Artificial Sequence: Synthetic oligonucleotide
  Target: AGXT; (+) strand; PAM type: NRG; PAM sequence: GGG
cttggggaggcggggagcct

SEQ ID NO: 10927 - DNA, 20 bp, Artificial Sequence
  Description of Artificial Sequence: Synthetic oligonucleotide
  Target: AGXT; (+) strand; PAM type: NRG; PAM sequence: CAG
caccctataccacccgcatg

SEQ ID NO: 10928 - DNA, 20 bp, Artificial Sequence
  Description of Artificial Sequence: Synthetic oligonucleotide
  Target: AGXT; (+) strand; PAM type: NRG; PAM sequence: TGG
taccacccgcatgcagatca

SEQ ID NO: 10929 - DNA, 20 bp, Artificial Sequence
  Description of Artificial Sequence: Synthetic oligonucleotide
  Target: AGXT; (+) strand; PAM type: NRG; PAM sequence: GAG
cccgcatgcagatcatggac

SEQ ID NO: 10930 - DNA, 20 bp, Artificial Sequence
  Description of Artificial Sequence: Synthetic oligonucleotide
  Target: AGXT; (+) strand; PAM type: NRG; PAM sequence: AAG
tgcagatcatggacgagatc

SEQ ID NO: 10931 - DNA, 20 bp, Artificial Sequence
  Description of Artificial Sequence: Synthetic oligonucleotide
  Target: AGXT; (+) strand; PAM type: NRG; PAM sequence: AGG
gcagatcatggacgagatca

SEQ ID NO: 10932 - DNA, 20 bp, Artificial Sequence
  Description of Artificial Sequence: Synthetic oligonucleotide
  Target: AGXT; (+) strand; PAM type: NRG; PAM sequence: AAG
gatcatggacgagatcaagg

SEQ ID NO: 10933 - DNA, 20 bp, Artificial Sequence
  Description of Artificial Sequence: Synthetic oligonucleotide
  Target: AGXT; (+) strand; PAM type: NRG; PAM sequence: AGG
atcatggacgagatcaagga

SEQ ID NO: 10934 - DNA, 20 bp, Artificial Sequence
  Description of Artificial Sequence: Synthetic oligonucleotide
  Target: AGXT; (+) strand; PAM type: NRG; PAM sequence: CAG
acgagatcaaggaaggcatc

SEQ ID NO: 10935 - DNA, 20 bp, Artificial Sequence
  Description of Artificial Sequence: Synthetic oligonucleotide
  Target: AGXT; (+) strand; PAM type: NRG; PAM sequence: CAG
aaggcatccagtacgtgttc

SEQ ID NO: 10936 - DNA, 20 bp, Artificial Sequence
  Description of Artificial Sequence: Synthetic oligonucleotide
  Target: AGXT; (+) strand; PAM type: NRG; PAM sequence: CAG
atccagtacgtgttccagac

SEQ ID NO: 10937 - DNA, 20 bp, Artificial Sequence
  Description of Artificial Sequence: Synthetic oligonucleotide
  Target: AGXT; (+) strand; PAM type: NRG; PAM sequence: AGG
tccagtacgtgttccagacc

SEQ ID NO: 10938 - DNA, 20 bp, Artificial Sequence
  Description of Artificial Sequence: Synthetic oligonucleotide
  Target: AGXT; (+) strand; PAM type: NRG; PAM sequence: TGG
gaccaggaacccactcacac

SEQ ID NO: 10939 - DNA, 20 bp, Artificial Sequence
  Description of Artificial Sequence: Synthetic oligonucleotide
  Target: AGXT; (+) strand; PAM type: NRG; PAM sequence: TGG
ccactcacactggtcatctc

SEQ ID NO: 10940 - DNA, 20 bp, Artificial Sequence
  Description of Artificial Sequence: Synthetic oligonucleotide
  Target: AGXT; (+) strand; PAM type: NRG; PAM sequence: CGG
cacactggtcatctctggct

SEQ ID NO: 10941 - DNA, 20 bp, Artificial Sequence
  Description of Artificial Sequence: Synthetic oligonucleotide
  Target: AGXT; (+) strand; PAM type: NRG; PAM sequence: GGG
acactggtcatctctggctc

SEQ ID NO: 10942 - DNA, 20 bp, Artificial Sequence
  Description of Artificial Sequence: Synthetic oligonucleotide
  Target: AGXT; (+) strand; PAM type: NRG; PAM sequence: TGG
tggctcgggacactgtgccc

SEQ ID NO: 10943 - DNA, 20 bp, Artificial Sequence
  Description of Artificial Sequence: Synthetic oligonucleotide
  Target: AGXT; (+) strand; PAM type: NRG; PAM sequence: GAG
gctcgggacactgtgccctg

SEQ ID NO: 10944 - DNA, 20 bp, Artificial Sequence
  Description of Artificial Sequence: Synthetic oligonucleotide
  Target: AGXT; (+) strand; PAM type: NRG; PAM sequence: AGG
ctcgggacactgtgccctgg

SEQ ID NO: 10945 - DNA, 20 bp, Artificial Sequence
  Description of Artificial Sequence: Synthetic oligonucleotide
  Target: AGXT; (+) strand; PAM type: NRG; PAM sequence: TGG
ctgtgccctggaggccgccc

SEQ ID NO: 10946 - DNA, 20 bp, Artificial Sequence
  Description of Artificial Sequence: Synthetic oligonucleotide
  Target: AGXT; (+) strand; PAM type: NRG; PAM sequence: TGG
ggccgccctggtcaatgtgc

SEQ ID NO: 10947 - DNA, 20 bp, Artificial Sequence
  Description of Artificial Sequence: Synthetic oligonucleotide
  Target: AGXT; (+) strand; PAM type: NRG; PAM sequence: GAG
ccgccctggtcaatgtgctg

SEQ ID NO: 10948 - DNA, 20 bp, Artificial Sequence
  Description of Artificial Sequence: Synthetic oligonucleotide
  Target: AGXT; (+) strand; PAM type: NRG; PAM sequence: TGG
ctggtcaatgtgctggagcc

SEQ ID NO: 10949 - DNA, 20 bp, Artificial Sequence
  Description of Artificial Sequence: Synthetic oligonucleotide
  Target: AGXT; (+) strand; PAM type: NRG; PAM sequence: GGG
tggtcaatgtgctggagcct

SEQ ID NO: 10950 - DNA, 20 bp, Artificial Sequence
  Description of Artificial Sequence: Synthetic oligonucleotide
  Target: AGXT; (+) strand; PAM type: NRG; PAM sequence: GGG
ggtcaatgtgctggagcctg

SEQ ID NO: 10951 - DNA, 20 bp, Artificial Sequence
  Description of Artificial Sequence: Synthetic oligonucleotide
  Target: AGXT; (+) strand; PAM type: NRG; PAM sequence: TGG
ggagcctggggactccttcc

SEQ ID NO: 10952 - DNA, 20 bp, Artificial Sequence
  Description of Artificial Sequence: Synthetic oligonucleotide
  Target: AGXT; (+) strand; PAM type: NRG; PAM sequence: TGG
cctggggactccttcctggt

SEQ ID NO: 10953 - DNA, 20 bp, Artificial Sequence
  Description of Artificial Sequence: Synthetic oligonucleotide
  Target: AGXT; (+) strand; PAM type: NRG; PAM sequence: GGG
ctggggactccttcctggtt

SEQ ID NO: 10954 - DNA, 20 bp, Artificial Sequence
  Description of Artificial Sequence: Synthetic oligonucleotide
  Target: AGXT; (+) strand; PAM type: NRG; PAM sequence: GGG
tggggactccttcctggttg

SEQ ID NO: 10955 - DNA, 20 bp, Artificial Sequence
  Description of Artificial Sequence: Synthetic oligonucleotide
  Target: AGXT; (+) strand; PAM type: NRG; PAM sequence: TGG
tccttcctggttggggccaa

SEQ ID NO: 10956 - DNA, 20 bp, Artificial Sequence
  Description of Artificial Sequence: Synthetic oligonucleotide
  Target: AGXT; (+) strand; PAM type: NRG; PAM sequence: TGG
tggttggggccaatggcatt

SEQ ID NO: 10957 - DNA, 20 bp, Artificial Sequence
  Description of Artificial Sequence: Synthetic oligonucleotide
  Target: AGXT; (+) strand; PAM type: NRG; PAM sequence: GGG
ggttggggccaatggcattt

SEQ ID NO: 10958 - DNA, 20 bp, Artificial Sequence
  Description of Artificial Sequence: Synthetic oligonucleotide
  Target: AGXT; (+) strand; PAM type: NRG; PAM sequence: GGG
gttggggccaatggcatttg

SEQ ID NO: 10959 - DNA, 20 bp, Artificial Sequence
  Description of Artificial Sequence: Synthetic oligonucleotide
  Target: AGXT; (+) strand; PAM type: NRG; PAM sequence: GGG
ttggggccaatggcatttgg

SEQ ID NO: 10960 - DNA, 20 bp, Artificial Sequence
  Description of Artificial Sequence: Synthetic oligonucleotide
  Target: AGXT; (+) strand; PAM type: NRG; PAM sequence: CAG
gggccaatggcatttggggg

SEQ ID NO: 10961 - DNA, 20 bp, Artificial Sequence
  Description of Artificial Sequence: Synthetic oligonucleotide
  Target: AGXT; (+) strand; PAM type: NRG; PAM sequence: GAG
caatggcatttgggggcagc

SEQ ID NO: 10962 - DNA, 20 bp, Artificial Sequence
  Description of Artificial Sequence: Synthetic oligonucleotide
  Target: AGXT; (+) strand; PAM type: NRG; PAM sequence: TGG
catttgggggcagcgagccg

SEQ ID NO: 10963 - DNA, 20 bp, Artificial Sequence
  Description of Artificial Sequence: Synthetic oligonucleotide
  Target: AGXT; (+) strand; PAM type: NRG; PAM sequence: CGG
gggcagcgagccgtggacat

SEQ ID NO: 10964 - DNA, 20 bp, Artificial Sequence
  Description of Artificial Sequence: Synthetic oligonucleotide
  Target: AGXT; (+) strand; PAM type: NRG; PAM sequence: GGG
ggcagcgagccgtggacatc

SEQ ID NO: 10965 - DNA, 20 bp, Artificial Sequence
  Description of Artificial Sequence: Synthetic oligonucleotide
  Target: AGXT; (+) strand; PAM type: NRG; PAM sequence: GGG
gcagcgagccgtggacatcg

SEQ ID NO: 10966 - DNA, 20 bp, Artificial Sequence
  Description of Artificial Sequence: Synthetic oligonucleotide
  Target: AGXT; (+) strand; PAM type: NRG; PAM sequence: GAG
agcgagccgtggacatcggg

SEQ ID NO: 10967 - DNA, 20 bp, Artificial Sequence
  Description of Artificial Sequence: Synthetic oligonucleotide
  Target: AGXT; (+) strand; PAM type: NRG; PAM sequence: TAG
cgtggacatcggggagcgca

SEQ ID NO: 10968 - DNA, 20 bp, Artificial Sequence
  Description of Artificial Sequence: Synthetic oligonucleotide
  Target: AGXT; (+) strand; PAM type: NRG; PAM sequence: AGG
gtggacatcggggagcgcat

SEQ ID NO: 10969 - DNA, 20 bp, Artificial Sequence
  Description of Artificial Sequence: Synthetic oligonucleotide
  Target: AGXT; (+) strand; PAM type: NRG; PAM sequence: AAG
acatcggggagcgcataggt

SEQ ID NO: 10970 - DNA, 20 bp, Artificial Sequence
  Description of Artificial Sequence: Synthetic oligonucleotide
  Target: AGXT; (+) strand; PAM type: NRG; PAM sequence: AGG
catcggggagcgcataggta

SEQ ID NO: 10971 - DNA, 20 bp, Artificial Sequence
  Description of Artificial Sequence: Synthetic oligonucleotide
  Target: AGXT; (+) strand; PAM type: NRG; PAM sequence: GGG
atcggggagcgcataggtaa

SEQ ID NO: 10972 - DNA, 20 bp, Artificial Sequence
  Description of Artificial Sequence: Synthetic oligonucleotide
  Target: AGXT; (+) strand; PAM type: NRG; PAM sequence: GAG
cggggagcgcataggtaagg

SEQ ID NO: 10973 - DNA, 20 bp, Artificial Sequence
  Description of Artificial Sequence: Synthetic oligonucleotide
  Target: AGXT; (+) strand; PAM type: NRG; PAM sequence: GAG
gggagcgcataggtaaggga

SEQ ID NO: 10974 - DNA, 20 bp, Artificial Sequence
  Description of Artificial Sequence: Synthetic oligonucleotide
  Target: AGXT; (+) strand; PAM type: NRG; PAM sequence: AGG
ggagcgcataggtaagggag

SEQ ID NO: 10975 - DNA, 20 bp, Artificial Sequence
  Description of Artificial Sequence: Synthetic oligonucleotide
  Target: AGXT; (+) strand; PAM type: NRG; PAM sequence: CAG
gcataggtaagggagaggcc

SEQ ID NO: 10976 - DNA, 20 bp, Artificial Sequence
  Description of Artificial Sequence: Synthetic oligonucleotide
  Target: AGXT; (+) strand; PAM type: NRG; PAM sequence: AGG
cataggtaagggagaggccc

SEQ ID NO: 10977 - DNA, 20 bp, Artificial Sequence
  Description of Artificial Sequence: Synthetic oligonucleotide
  Target: AGXT; (+) strand; PAM type: NRG; PAM sequence: TGG
aggtaagggagaggcccagg

SEQ ID NO: 10978 - DNA, 20 bp, Artificial Sequence
  Description of Artificial Sequence: Synthetic oligonucleotide
  Target: AGXT; (+) strand; PAM type: NRG; PAM sequence: GGG
ggtaagggagaggcccaggt

SEQ ID NO: 10979 - DNA, 20 bp, Artificial Sequence
  Description of Artificial Sequence: Synthetic oligonucleotide
  Target: AGXT; (+) strand; PAM type: NRG; PAM sequence: GGG
gtaagggagaggcccaggtg

SEQ ID NO: 10980 - DNA, 20 bp, Artificial Sequence
  Description of Artificial Sequence: Synthetic oligonucleotide
  Target: AGXT; (+) strand; PAM type: NRG; PAM sequence: TGG
gggagaggcccaggtgggga

SEQ ID NO: 10981 - DNA, 20 bp, Artificial Sequence
  Description of Artificial Sequence: Synthetic oligonucleotide
  Target: AGXT; (+) strand; PAM type: NRG; PAM sequence: TGG
ggcccaggtggggatggccc

SEQ ID NO: 10982 - DNA, 20 bp, Artificial Sequence
  Description of Artificial Sequence: Synthetic oligonucleotide
  Target: AGXT; (+) strand; PAM type: NRG; PAM sequence: AAG
tggccctggatccatccttc

SEQ ID NO: 10983 - DNA, 20 bp, Artificial Sequence
  Description of Artificial Sequence: Synthetic oligonucleotide
  Target: AGXT; (+) strand; PAM type: NRG; PAM sequence: AGG
ggccctggatccatccttca

SEQ ID NO: 10984 - DNA, 20 bp, Artificial Sequence
  Description of Artificial Sequence: Synthetic oligonucleotide
  Target: AGXT; (+) strand; PAM type: NRG; PAM sequence: TGG
tccatccttcaaggcctccc

SEQ ID NO: 10985 - DNA, 20 bp, Artificial Sequence
  Description of Artificial Sequence: Synthetic oligonucleotide
  Target: AGXT; (+) strand; PAM type: NRG; PAM sequence: AAG
ccctggcctccctctgtttg

SEQ ID NO: 10986 - DNA, 20 bp, Artificial Sequence
  Description of Artificial Sequence: Synthetic oligonucleotide
  Target: AGXT; (+) strand; PAM type: NRG; PAM sequence: TGG
ggcctccctctgtttgaagc

SEQ ID NO: 10987 - DNA, 20 bp, Artificial Sequence
  Description of Artificial Sequence: Synthetic oligonucleotide
  Target: AGXT; (+) strand; PAM type: NRG; PAM sequence: CAG
ctccctctgtttgaagctgg

SEQ ID NO: 10988 - DNA, 20 bp, Artificial Sequence
  Description of Artificial Sequence: Synthetic oligonucleotide
  Target: AGXT; (+) strand; PAM type: NRG; PAM sequence: TGG
aagctggcagcccccgttcc

SEQ ID NO: 10989 - DNA, 20 bp, Artificial Sequence
  Description of Artificial Sequence: Synthetic oligonucleotide
  Target: AGXT; (+) strand; PAM type: NRG; PAM sequence: GGG
agctggcagcccccgttcct

SEQ ID NO: 10990 - DNA, 20 bp, Artificial Sequence
  Description of Artificial Sequence: Synthetic oligonucleotide
  Target: AGXT; (+) strand; PAM type: NRG; PAM sequence: GAG
ggcagcccccgttcctgggt

SEQ ID NO: 10991 - DNA, 20 bp, Artificial Sequence
  Description of Artificial Sequence: Synthetic oligonucleotide
  Target: AGXT; (+) strand; PAM type: NRG; PAM sequence: TGG
gtgagcgcttacccaccttg

SEQ ID NO: 10992 - DNA, 20 bp, Artificial Sequence
  Description of Artificial Sequence: Synthetic oligonucleotide
  Target: AGXT; (+) strand; PAM type: NRG; PAM sequence: CAG
tgtgcgcacgaacctcctgc

SEQ ID NO: 10993 - DNA, 20 bp, Artificial Sequence
  Description of Artificial Sequence: Synthetic oligonucleotide
  Target: AGXT; (+) strand; PAM type: NRG; PAM sequence: CAG
tgccagcccactgcctcctc

SEQ ID NO: 10994 - DNA, 20 bp, Artificial Sequence
  Description of Artificial Sequence: Synthetic oligonucleotide
  Target: AGXT; (+) strand; PAM type: NRG; PAM sequence: AGG
gccagcccactgcctcctcc

SEQ ID NO: 10995 - DNA, 20 bp, Artificial Sequence
  Description of Artificial Sequence: Synthetic oligonucleotide
  Target: AGXT; (+) strand; PAM type: NRG; PAM sequence: CGG
agcccactgcctcctccagg

SEQ ID NO: 10996 - DNA, 20 bp, Artificial Sequence
  Description of Artificial Sequence: Synthetic oligonucleotide
  Target: AGXT; (+) strand; PAM type: NRG; PAM sequence: CGG
ctgcctcctccaggcggtgt

SEQ ID NO: 10997 - DNA, 20 bp, Artificial Sequence
  Description of Artificial Sequence: Synthetic oligonucleotide
  Target: AGXT; (+) strand; PAM type: NRG; PAM sequence: GGG
tgcctcctccaggcggtgtc

SEQ ID NO: 10998 - DNA, 20 bp, Artificial Sequence
  Description of Artificial Sequence: Synthetic oligonucleotide
  Target: AGXT; (+) strand; PAM type: NRG; PAM sequence: GAG
aggcggtgtcgggcactcat

SEQ ID NO: 10999 - DNA, 20 bp, Artificial Sequence
  Description of Artificial Sequence: Synthetic oligonucleotide
  Target: AGXT; (+) strand; PAM type: NRG; PAM sequence: AGG
ggcggtgtcgggcactcatg

SEQ ID NO: 11000 - DNA, 20 bp, Artificial Sequence
  Description of Artificial Sequence: Synthetic oligonucleotide
  Target: AGXT; (+) strand; PAM type: NRG; PAM sequence: TAG
ctcatgaggcctgactctga

SEQ ID NO: 11001 - DNA, 20 bp, Artificial Sequence
  Description of Artificial Sequence: Synthetic oligonucleotide
  Target: AGXT; (+) strand; PAM type: NRG; PAM sequence: AGG
tcatgaggcctgactctgat

SEQ ID NO: 11002 - DNA, 20 bp, Artificial Sequence
  Description of Artificial Sequence: Synthetic oligonucleotide
  Target: AGXT; (+) strand; PAM type: NRG; PAM sequence: GGG
catgaggcctgactctgata

SEQ ID NO: 11003 - DNA, 20 bp, Artificial Sequence
  Description of Artificial Sequence: Synthetic oligonucleotide
  Target: AGXT; (+) strand; PAM type: NRG; PAM sequence: TGG
aggcctgactctgatagggc

SEQ ID NO: 11004 - DNA, 20 bp, Artificial Sequence
  Description of Artificial Sequence: Synthetic oligonucleotide
  Target: AGXT; (+) strand; PAM type: NRG; PAM sequence: GGG
ggcctgactctgatagggct

SEQ ID NO: 11005 - DNA, 20 bp, Artificial Sequence
  Description of Artificial Sequence: Synthetic oligonucleotide
  Target: AGXT; (+) strand; PAM type: NRG; PAM sequence: GAG
cctgactctgatagggctgg

SEQ ID NO: 11006 - DNA, 20 bp, Artificial Sequence
  Description of Artificial Sequence: Synthetic oligonucleotide
  Target: AGXT; (+) strand; PAM type: NRG; PAM sequence: CAG
gactctgatagggctgggag

SEQ ID NO: 11007 - DNA, 20 bp, Artificial Sequence
  Description of Artificial Sequence: Synthetic oligonucleotide
  Target: AGXT; (+) strand; PAM type: NRG; PAM sequence: CAG
tgatagggctgggagcagca

SEQ ID NO: 11008 - DNA, 20 bp, Artificial Sequence
  Description of Artificial Sequence: Synthetic oligonucleotide
  Target: AGXT; (+) strand; PAM type: NRG; PAM sequence: AGG
gatagggctgggagcagcac

SEQ ID NO: 11009 - DNA, 20 bp, Artificial Sequence
  Description of Artificial Sequence: Synthetic oligonucleotide
  Target: AGXT; (+) strand; PAM type: NRG; PAM sequence: CAG
cacaggtgccccgatccccc

SEQ ID NO: 11010 - DNA, 20 bp, Artificial Sequence
  Description of Artificial Sequence: Synthetic oligonucleotide
  Target: AGXT; (+) strand; PAM type: NRG; PAM sequence: GAG
ccgatccccccagtctcctt

SEQ ID NO: 11011 - DNA, 20 bp, Artificial Sequence
  Description of Artificial Sequence: Synthetic oligonucleotide
  Target: AGXT; (+) strand; PAM type: NRG; PAM sequence: TGG
cagtctccttgagctgtttc

SEQ ID NO: 11012 - DNA, 20 bp, Artificial Sequence
  Description of Artificial Sequence: Synthetic oligonucleotide
  Target: AGXT; (+) strand; PAM type: NRG; PAM sequence: GAG
gtctccttgagctgtttctg

SEQ ID NO: 11013 - DNA, 20 bp, Artificial Sequence
  Description of Artificial Sequence: Synthetic oligonucleotide
  Target: AGXT; (+) strand; PAM type: NRG; PAM sequence: CAG
agctgtttctggagcatgtg

SEQ ID NO: 11014 - DNA, 20 bp, Artificial Sequence
  Description of Artificial Sequence: Synthetic oligonucleotide
  Target: AGXT; (+) strand; PAM type: NRG; PAM sequence: AGG
gctgtttctggagcatgtgc

SEQ ID NO: 11015 - DNA, 20 bp, Artificial Sequence
  Description of Artificial Sequence: Synthetic oligonucleotide
  Target: AGXT; (+) strand; PAM type: NRG; PAM sequence: CGG
tttctggagcatgtgcagga

SEQ ID NO: 11016 - DNA, 20 bp, Artificial Sequence
  Description of Artificial Sequence: Synthetic oligonucleotide
  Target: AGXT; (+) strand; PAM type: NRG; PAM sequence: CAG
gcatgtgcaggacggaacta

SEQ ID NO: 11017 - DNA, 20 bp, Artificial Sequence
  Description of Artificial Sequence: Synthetic oligonucleotide
  Target: AGXT; (+) strand; PAM type: NRG; PAM sequence: AGG
catgtgcaggacggaactac

SEQ ID NO: 11018 - DNA, 20 bp, Artificial Sequence
  Description of Artificial Sequence: Synthetic oligonucleotide
  Target: AGXT; (+) strand; PAM type: NRG; PAM sequence: GGG
atgtgcaggacggaactaca

SEQ ID NO: 11019 - DNA, 20 bp, Artificial Sequence
  Description of Artificial Sequence: Synthetic oligonucleotide
  Target: AGXT; (+) strand; PAM type: NRG; PAM sequence: AAG
tgcaggacggaactacaggg

SEQ ID NO: 11020 - DNA, 20 bp, Artificial Sequence
  Description of Artificial Sequence: Synthetic oligonucleotide
  Target: AGXT; (+) strand; PAM type: NRG; PAM sequence: TGG
cggaactacagggaagcctc

SEQ ID NO: 11021 - DNA, 20 bp, Artificial Sequence
  Description of Artificial Sequence: Synthetic oligonucleotide
  Target: AGXT; (+) strand; PAM type: NRG; PAM sequence: CAG
tacagggaagcctctggtcc

SEQ ID NO: 11022 - DNA, 20 bp, Artificial Sequence
  Description of Artificial Sequence: Synthetic oligonucleotide
  Target: AGXT; (+) strand; PAM type: NRG; PAM sequence: GAG
tggtcccagcacacactcct

SEQ ID NO: 11023 - DNA, 20 bp, Artificial Sequence
  Description of Artificial Sequence: Synthetic oligonucleotide
  Target: AGXT; (+) strand; PAM type: NRG; PAM sequence: GAG
gtcccagcacacactcctga

SEQ ID NO: 11024 - DNA, 20 bp, Artificial Sequence
  Description of Artificial Sequence: Synthetic oligonucleotide
  Target: AGXT; (+) strand; PAM type: NRG; PAM sequence: CGG
gcacacactcctgagagccc

SEQ ID NO: 11025 - DNA, 20 bp, Artificial Sequence
  Description of Artificial Sequence: Synthetic oligonucleotide
  Target: AGXT; (+) strand; PAM type: NRG; PAM sequence: CAG
tgagagccccggccgctgtc

SEQ ID NO: 11026 - DNA, 20 bp, Artificial Sequence
  Description of Artificial Sequence: Synthetic oligonucleotide
  Target: AGXT; (+) strand; PAM type: NRG; PAM sequence: AGG
gagagccccggccgctgtcc

SEQ ID NO: 11027 - DNA, 20 bp, Artificial Sequence
  Description of Artificial Sequence: Synthetic oligonucleotide
  Target: AGXT; (+) strand; PAM type: NRG; PAM sequence: GGG
agagccccggccgctgtcca

SEQ ID NO: 11028 - DNA, 20 bp, Artificial Sequence
  Description of Artificial Sequence: Synthetic oligonucleotide
  Target: AGXT; (+) strand; PAM type: NRG; PAM sequence: CAG
ccggccgctgtccagggccc

SEQ ID NO: 11029 - DNA, 20 bp, Artificial Sequence
  Description of Artificial Sequence: Synthetic oligonucleotide
  Target: AGXT; (+) strand; PAM type: NRG; PAM sequence: AGG
cggccgctgtccagggcccc

SEQ ID NO: 11030 - DNA, 20 bp, Artificial Sequence
  Description of Artificial Sequence: Synthetic oligonucleotide
  Target: AGXT; (+) strand; PAM type: NRG; PAM sequence: CAG
ctgtccagggccccaggcac

SEQ ID NO: 11031 - DNA, 20 bp, Artificial Sequence
  Description of Artificial Sequence: Synthetic oligonucleotide
  Target: AGXT; (+) strand; PAM type: NRG; PAM sequence: CAG
gcaccagctctgctttgtga

SEQ ID NO: 11032 - DNA, 20 bp, Artificial Sequence
  Description of Artificial Sequence: Synthetic oligonucleotide
  Target: AGXT; (+) strand; PAM type: NRG; PAM sequence: AGG
caccagctctgctttgtgac

SEQ ID NO: 11033 - DNA, 20 bp, Artificial Sequence
  Description of Artificial Sequence: Synthetic oligonucleotide
  Target: AGXT; (+) strand; PAM type: NRG; PAM sequence: GGG
accagctctgctttgtgaca

SEQ ID NO: 11034 - DNA, 20 bp, Artificial Sequence
  Description of Artificial Sequence: Synthetic oligonucleotide
  Target: AGXT; (+) strand; PAM type: NRG; PAM sequence: TGG
agctctgctttgtgacaggg

SEQ ID NO: 11035 - DNA, 20 bp, Artificial Sequence
  Description of Artificial Sequence: Synthetic oligonucleotide
  Target: AGXT; (+) strand; PAM type: NRG; PAM sequence: GGG
gctctgctttgtgacagggt

SEQ ID NO: 11036 - DNA, 20 bp, Artificial Sequence
  Description of Artificial Sequence: Synthetic oligonucleotide
  Target: AGXT; (+) strand; PAM type: NRG; PAM sequence: GGG
ctctgctttgtgacagggtg

SEQ ID NO: 11037 - DNA, 20 bp, Artificial Sequence
  Description of Artificial Sequence: Synthetic oligonucleotide
  Target: AGXT; (+) strand; PAM type: NRG; PAM sequence: CAG
tttgtgacagggtggggttt

SEQ ID NO: 11038 - DNA, 20 bp, Artificial Sequence
  Description of Artificial Sequence: Synthetic oligonucleotide
  Target: AGXT; (+) strand; PAM type: NRG; PAM sequence: AAG
gtgacagggtggggtttcag

SEQ ID NO: 11039 - DNA, 20 bp, Artificial Sequence
  Description of Artificial Sequence: Synthetic oligonucleotide
  Target: AGXT; (+) strand; PAM type: NRG; PAM sequence: AAG
gggtggggtttcagaagctg

SEQ ID NO: 11040 - DNA, 20 bp, Artificial Sequence
  Description of Artificial Sequence: Synthetic oligonucleotide
  Target: AGXT; (+) strand; PAM type: NRG; PAM sequence: CAG
tgaagcctcccctcaaatct

SEQ ID NO: 11041 - DNA, 20 bp, Artificial Sequence
  Description of Artificial Sequence: Synthetic oligonucleotide
  Target: AGXT; (+) strand; PAM type: NRG; PAM sequence: CAG
agcctcccctcaaatctcag

SEQ ID NO: 11042 - DNA, 20 bp, Artificial Sequence
  Description of Artificial Sequence: Synthetic oligonucleotide
  Target: AGXT; (+) strand; PAM type: NRG; PAM sequence: TGG
aatctcagcagccttccttc

SEQ ID NO: 11043 - DNA, 20 bp, Artificial Sequence
  Description of Artificial Sequence: Synthetic oligonucleotide
  Target: AGXT; (+) strand; PAM type: NRG; PAM sequence: TGG
ttgatgtgatacacaaaata

SEQ ID NO: 11044 - DNA, 20 bp, Artificial Sequence
  Description of Artificial Sequence: Synthetic oligonucleotide
  Target: AGXT; (+) strand; PAM type: NRG; PAM sequence: GAG
gatgtgatacacaaaatatg

SEQ ID NO: 11045 - DNA, 20 bp, Artificial Sequence
  Description of Artificial Sequence: Synthetic oligonucleotide
  Target: AGXT; (+) strand; PAM type: NRG; PAM sequence: AGG
atgtgatacacaaaatatgg

SEQ ID NO: 11046 - DNA, 20 bp, Artificial Sequence
  Description of Artificial Sequence: Synthetic oligonucleotide
  Target: AGXT; (+) strand; PAM type: NRG; PAM sequence: TGG
atacacaaaatatggaggta

SEQ ID NO: 11047 - DNA, 20 bp, Artificial Sequence
  Description of Artificial Sequence: Synthetic oligonucleotide
  Target: AGXT; (+) strand; PAM type: NRG; PAM sequence: GGG
tacacaaaatatggaggtat

SEQ ID NO: 11048 - DNA, 20 bp, Artificial Sequence
  Description of Artificial Sequence: Synthetic oligonucleotide
  Target: AGXT; (+) strand; PAM type: NRG; PAM sequence: CAG
acaaaatatggaggtatggg

SEQ ID NO: 11049 - DNA, 20 bp, Artificial Sequence
  Description of Artificial Sequence: Synthetic oligonucleotide
  Target: AGXT; (+) strand; PAM type: NRG; PAM sequence: GAG
aaaatatggaggtatgggca

SEQ ID NO: 11050 - DNA, 20 bp, Artificial Sequence
  Description of Artificial Sequence: Synthetic oligonucleotide
  Target: AGXT; (+) strand; PAM type: NRG; PAM sequence: CGG
atgggcagagtattcgcctc

SEQ ID NO: 11051 - DNA, 20 bp, Artificial Sequence
  Description of Artificial Sequence: Synthetic oligonucleotide
  Target: AGXT; (+) strand; PAM type: NRG; PAM sequence: GAG
gggcagagtattcgcctccg

SEQ ID NO: 11052 - DNA, 20 bp, Artificial Sequence
  Description of Artificial Sequence: Synthetic oligonucleotide
  Target: AGXT; (+) strand; PAM type: NRG; PAM sequence: TGG
gcctccggagtacacttttc

SEQ ID NO: 11053 - DNA, 20 bp, Artificial Sequence
  Description of Artificial Sequence: Synthetic oligonucleotide
  Target: AGXT; (+) strand; PAM type: NRG; PAM sequence: GGG
cctccggagtacacttttct

SEQ ID NO: 11054 - DNA, 20 bp, Artificial Sequence
  Description of Artificial Sequence: Synthetic oligonucleotide
  Target: AGXT; (+) strand; PAM type: NRG; PAM sequence: GAG
tccggagtacacttttctgg

SEQ ID NO: 11055 - DNA, 20 bp, Artificial Sequence
  Description of Artificial Sequence: Synthetic oligonucleotide
  Target: AGXT; (+) strand; PAM type: NRG; PAM sequence: GAG
cggagtacacttttctggga

SEQ ID NO: 11056 - DNA, 20 bp, Artificial Sequence
  Description of Artificial Sequence: Synthetic oligonucleotide
  Target: AGXT; (+) strand; PAM type: NRG; PAM sequence: CAG
acacttttctgggagagaca

SEQ ID NO: 11057 - DNA, 20 bp, Artificial Sequence
  Description of Artificial Sequence: Synthetic oligonucleotide
  Target: AGXT; (+) strand; PAM type: NRG; PAM sequence: AGG
cacttttctgggagagacac

SEQ ID NO: 11058 - DNA, 20 bp, Artificial Sequence
  Description of Artificial Sequence: Synthetic oligonucleotide
  Target: AGXT; (+) strand; PAM type: NRG; PAM sequence: GAG
cttttctgggagagacacag

SEQ ID NO: 11059 - DNA, 20 bp, Artificial Sequence
  Description of Artificial Sequence: Synthetic oligonucleotide
  Target: AGXT; (+) strand; PAM type: NRG; PAM sequence: CAG
ttctgggagagacacaggag

SEQ ID NO: 11060 - DNA, 20 bp, Artificial Sequence
  Description of Artificial Sequence: Synthetic oligonucleotide
  Target: AGXT; (+) strand; PAM type: NRG; PAM sequence: AGG
tctgggagagacacaggagc

SEQ ID NO: 11061 - DNA, 20 bp, Artificial Sequence
  Description of Artificial Sequence: Synthetic oligonucleotide
  Target: AGXT; (+) strand; PAM type: NRG; PAM sequence: GAG
tgggagagacacaggagcag

SEQ ID NO: 11062 - DNA, 20 bp, Artificial Sequence
  Description of Artificial Sequence: Synthetic oligonucleotide
  Target: AGXT; (+) strand; PAM type: NRG; PAM sequence: TGG
acaggagcaggagtgtgccc

SEQ ID NO: 11063 - DNA, 20 bp, Artificial Sequence
  Description of Artificial Sequence: Synthetic oligonucleotide
  Target: AGXT; (+) strand; PAM type: NRG; PAM sequence: GGG
caggagcaggagtgtgccct

SEQ ID NO: 11064 - DNA, 20 bp, Artificial Sequence
  Description of Artificial Sequence: Synthetic oligonucleotide
  Target: AGXT; (+) strand; PAM type: NRG; PAM sequence: TGG
ctgggtttaatgattgattg

SEQ ID NO: 11065 - DNA, 20 bp, Artificial Sequence
  Description of Artificial Sequence: Synthetic oligonucleotide
  Target: AGXT; (+) strand; PAM type: NRG; PAM sequence: GAG
taatgattgattgtggcatt

SEQ ID NO: 11066 - DNA, 20 bp, Artificial Sequence
  Description of Artificial Sequence: Synthetic oligonucleotide
  Target: AGXT; (+) strand; PAM type: NRG; PAM sequence: AGG
aatgattgattgtggcattg

SEQ ID NO: 11067 - DNA, 20 bp, Artificial Sequence
  Description of Artificial Sequence: Synthetic oligonucleotide
  Target: AGXT; (+) strand; PAM type: NRG; PAM sequence: GGG
atgattgattgtggcattga

SEQ ID NO: 11068 - DNA, 20 bp, Artificial Sequence
  Description of Artificial Sequence: Synthetic oligonucleotide
  Target: AGXT; (+) strand; PAM type: NRG; PAM sequence: CAG
attgtggcattgagggacat

SEQ ID NO: 11069 - DNA, 20 bp, Artificial Sequence
  Description of Artificial Sequence: Synthetic oligonucleotide
  Target: AGXT; (+) strand; PAM type: NRG; PAM sequence: TGG
ggcattgagggacatcagct

SEQ ID NO: 11070 - DNA, 20 bp, Artificial Sequence
  Description of Artificial Sequence: Synthetic oligonucleotide
  Target: AGXT; (+) strand; PAM type: NRG; PAM sequence: GAG
ttgagggacatcagcttggt

SEQ ID NO: 11071 - DNA, 20 bp, Artificial Sequence
  Description of Artificial Sequence: Synthetic oligonucleotide
  Target: AGXT; (+) strand; PAM type: NRG; PAM sequence: TGG
cagcttggtgagctccacaa

SEQ ID NO: 11072 - DNA, 20 bp, Artificial Sequence
  Description of Artificial Sequence: Synthetic oligonucleotide
  Target: AGXT; (+) strand; PAM type: NRG; PAM sequence: TGG
gagctccacaatggccatgc

SEQ ID NO: 11073 - DNA, 20 bp, Artificial Sequence
  Description of Artificial Sequence: Synthetic oligonucleotide
  Target: AGXT; (+) strand; PAM type: NRG; PAM sequence: CAG
tggttaatacgcgaccgcaa

SEQ ID NO: 11074 - DNA, 20 bp, Artificial Sequence
  Description of Artificial Sequence: Synthetic oligonucleotide
  Target: AGXT; (+) strand; PAM type: NRG; PAM sequence: AAG
aatacgcgaccgcaacagcc

SEQ ID NO: 11075 - DNA, 20 bp, Artificial Sequence
  Description of Artificial Sequence: Synthetic oligonucleotide
  Target: AGXT; (+) strand; PAM type: NRG; PAM sequence: GAG
tacgcgaccgcaacagccaa

SEQ ID NO: 11076 - DNA, 20 bp, Artificial Sequence
  Description of Artificial Sequence: Synthetic oligonucleotide
  Target: AGXT; (+) strand; PAM type: NRG; PAM sequence: AGG
acgcgaccgcaacagccaag

SEQ ID NO: 11077 - DNA, 20 bp, Artificial Sequence
  Description of Artificial Sequence: Synthetic oligonucleotide
  Target: AGXT; (+) strand; PAM type: NRG; PAM sequence: GGG
cgcgaccgcaacagccaaga

SEQ ID NO: 11078 - DNA, 20 bp, Artificial Sequence
  Description of Artificial Sequence: Synthetic oligonucleotide
  Target: AGXT; (+) strand; PAM type: NRG; PAM sequence: AAG
gccaagagggtcccaacccc

SEQ ID NO: 11079 - DNA, 20 bp, Artificial Sequence
  Description of Artificial Sequence: Synthetic oligonucleotide
  Target: AGXT; (+) strand; PAM type: NRG; PAM sequence: AAG
cccaagtccacaaacttttc

SEQ ID NO: 11080 - DNA, 20 bp, Artificial Sequence
  Description of Artificial Sequence: Synthetic oligonucleotide
  Target: AGXT; (+) strand; PAM type: NRG; PAM sequence: AGG
ccaagtccacaaacttttca

SEQ ID NO: 11081 - DNA, 20 bp, Artificial Sequence
  Description of Artificial Sequence: Synthetic oligonucleotide
  Target: AGXT; (+) strand; PAM type: NRG; PAM sequence: GGG
caagtccacaaacttttcaa

SEQ ID NO: 11082 - DNA, 20 bp, Artificial Sequence
  Description of Artificial Sequence: Synthetic oligonucleotide
  Target: AGXT; (+) strand; PAM type: NRG; PAM sequence: GGG
aagtccacaaacttttcaag

SEQ ID NO: 11083 - DNA, 20 bp, Artificial Sequence
  Description of Artificial Sequence: Synthetic oligonucleotide
  Target: AGXT; (+) strand; PAM type: NRG; PAM sequence: CAG
acaaacttttcaaggggacc

SEQ ID NO: 11084 - DNA, 20 bp, Artificial Sequence
  Description of Artificial Sequence: Synthetic oligonucleotide
  Target: AGXT; (+) strand; PAM type: NRG; PAM sequence: AGG
caaacttttcaaggggaccc

SEQ ID NO: 11085 - DNA, 20 bp, Artificial Sequence
  Description of Artificial Sequence: Synthetic oligonucleotide
  Target: AGXT; (+) strand; PAM type: NRG; PAM sequence: GGG
aaacttttcaaggggaccca

SEQ ID NO: 11086 - DNA, 20 bp, Artificial Sequence
  Description of Artificial Sequence: Synthetic oligonucleotide
  Target: AGXT; (+) strand; PAM type: NRG; PAM sequence: CGG
ttttcaaggggacccagggt

SEQ ID NO: 11087 - DNA, 20 bp, Artificial Sequence
  Description of Artificial Sequence: Synthetic oligonucleotide
  Target: AGXT; (+) strand; PAM type: NRG; PAM sequence: CAG
tcaaggggacccagggtcgg

SEQ ID NO: 11088 - DNA, 20 bp, Artificial Sequence
  Description of Artificial Sequence: Synthetic oligonucleotide
  Target: AGXT; (+) strand; PAM type: NRG; PAM sequence: GAG
aaggggacccagggtcggca

SEQ ID NO: 11089 - DNA, 20 bp, Artificial Sequence
  Description of Artificial Sequence: Synthetic oligonucleotide
  Target: AGXT; (+) strand; PAM type: NRG; PAM sequence: AGG
aggggacccagggtcggcag

SEQ ID NO: 11090 - DNA, 20 bp, Artificial Sequence
  Description of Artificial Sequence: Synthetic oligonucleotide
  Target: AGXT; (+) strand; PAM type: NRG; PAM sequence: CAG
gacccagggtcggcagaggc

SEQ ID NO: 11091 - DNA, 20 bp, Artificial Sequence
  Description of Artificial Sequence: Synthetic oligonucleotide
  Target: AGXT; (+) strand; PAM type: NRG; PAM sequence: AGG
acccagggtcggcagaggcc

SEQ ID NO: 11092 - DNA, 20 bp, Artificial Sequence
  Description of Artificial Sequence: Synthetic oligonucleotide
  Target: AGXT; (+) strand; PAM type: NRG; PAM sequence: AAG
tcggcagaggccaggacccc

SEQ ID NO: 11093 - DNA, 20 bp, Artificial Sequence
  Description of Artificial Sequence: Synthetic oligonucleotide
  Target: AGXT; (+) strand; PAM type: NRG; PAM sequence: TGG
gcagaggccaggaccccaag

SEQ ID NO: 11094 - DNA, 20 bp, Artificial Sequence
  Description of Artificial Sequence: Synthetic oligonucleotide
  Target: AGXT; (+) strand; PAM type: NRG; PAM sequence: CAG
ccaggaccccaagtggacat

SEQ ID NO: 11095 - DNA, 20 bp, Artificial Sequence
  Description of Artificial Sequence: Synthetic oligonucleotide
  Target: AGXT; (+) strand; PAM type: NRG; PAM sequence: AGG
caggaccccaagtggacatc

SEQ ID NO: 11096 - DNA, 20 bp, Artificial Sequence
  Description of Artificial Sequence: Synthetic oligonucleotide
  Target: AGXT; (+) strand; PAM type: NRG; PAM sequence: GGG
aggaccccaagtggacatca

SEQ ID NO: 11097 - DNA, 20 bp, Artificial Sequence
  Description of Artificial Sequence: Synthetic oligonucleotide
  Target: AGXT; (+) strand; PAM type: NRG; PAM sequence: CAG
caagtggacatcagggcacg

SEQ ID NO: 11098 - DNA, 20 bp, Artificial Sequence
  Description of Artificial Sequence: Synthetic oligonucleotide
  Target: AGXT; (+) strand; PAM type: NRG; PAM sequence: AGG
aagtggacatcagggcacgc

SEQ ID NO: 11099 - DNA, 20 bp, Artificial Sequence
  Description of Artificial Sequence: Synthetic oligonucleotide
  Target: AGXT; (+) strand; PAM type: NRG; PAM sequence: CAG
gacatcagggcacgcaggct

SEQ ID NO: 11100 - DNA, 20 bp, Artificial Sequence
  Description of Artificial Sequence: Synthetic oligonucleotide
  Target: AGXT; (+) strand; PAM type: NRG; PAM sequence: TGG
cacgcaggctcagatgcctg

SEQ ID NO: 11101 - DNA, 20 bp, Artificial Sequence
  Description of Artificial Sequence: Synthetic oligonucleotide
  Target: AGXT; (+) strand; PAM type: NRG; PAM sequence: TGG
gctcagatgcctgtggtata

SEQ ID NO: 11102 - DNA, 20 bp, Artificial Sequence
  Description of Artificial Sequence: Synthetic oligonucleotide
  Target: AGXT; (+) strand; PAM type: NRG; PAM sequence: TGG
ttttccccattctgtcccct

SEQ ID NO: 11103 - DNA, 20 bp, Artificial Sequence
  Description of Artificial Sequence: Synthetic oligonucleotide
  Target: AGXT; (+) strand; PAM type: NRG; PAM sequence: CAG
ccattctgtccccttggccg

SEQ ID NO: 11104 - DNA, 20 bp, Artificial Sequence
  Description of Artificial Sequence: Synthetic oligonucleotide
  Target: AGXT; (+) strand; PAM type: NRG; PAM sequence: AGG
cattctgtccccttggccgc

SEQ ID NO: 11105 - DNA, 20 bp, Artificial Sequence
  Description of Artificial Sequence: Synthetic oligonucleotide
  Target: AGXT; (+) strand; PAM type: NRG; PAM sequence: TGG
gttcttcccctcccacaacc

SEQ ID NO: 11106 - DNA, 20 bp, Artificial Sequence
  Description of Artificial Sequence: Synthetic oligonucleotide
  Target: AGXT; (+) strand; PAM type: NRG; PAM sequence: CAG
tcccacaacctggccctgaa

SEQ ID NO: 11107 - DNA, 20 bp, Artificial Sequence
  Description of Artificial Sequence: Synthetic oligonucleotide
  Target: AGXT; (+) strand; PAM type: NRG; PAM sequence: CAG
acctggccctgaacagcaca

SEQ ID NO: 11108 - DNA, 20 bp, Artificial Sequence
  Description of Artificial Sequence: Synthetic oligonucleotide
  Target: AGXT; (+) strand; PAM type: NRG; PAM sequence: AGG
cctggccctgaacagcacac

SEQ ID NO: 11109 - DNA, 20 bp, Artificial Sequence
  Description of Artificial Sequence: Synthetic oligonucleotide
  Target: AGXT; (+) strand; PAM type: NRG; PAM sequence: TAG
gccctgaacagcacacagga

SEQ ID NO: 11110 - DNA, 20 bp, Artificial Sequence
  Description of Artificial Sequence: Synthetic oligonucleotide
  Target: AGXT; (+) strand; PAM type: NRG; PAM sequence: AGG
ccctgaacagcacacaggat

SEQ ID NO: 11111 - DNA, 20 bp, Artificial Sequence
  Description of Artificial Sequence: Synthetic oligonucleotide
  Target: AGXT; (+) strand; PAM type: NRG; PAM sequence: GGG
cctgaacagcacacaggata

SEQ ID NO: 11112 - DNA, 20 bp, Artificial Sequence
  Description of Artificial Sequence: Synthetic oligonucleotide
  Target: AGXT; (+) strand; PAM type: NRG; PAM sequence: CAG
gaacagcacacaggataggg

SEQ ID NO: 11113 - DNA, 20 bp, Artificial Sequence
  Description of Artificial Sequence: Synthetic oligonucleotide
  Target: AGXT; (+) strand; PAM type: NRG; PAM sequence: GAG
acagcacacaggatagggca

SEQ ID NO: 11114 - DNA, 20 bp, Artificial Sequence
  Description of Artificial Sequence: Synthetic oligonucleotide
  Target: AGXT; (+) strand; PAM type: NRG; PAM sequence: CAG
cacacaggatagggcagaga

SEQ ID NO: 11115 - DNA, 20 bp, Artificial Sequence
  Description of Artificial Sequence: Synthetic oligonucleotide
  Target: AGXT; (+) strand; PAM type: NRG; PAM sequence: AGG
acacaggatagggcagagac

SEQ ID NO: 11116 - DNA, 20 bp, Artificial Sequence
  Description of Artificial Sequence: Synthetic oligonucleotide
  Target: AGXT; (+) strand; PAM type: NRG; PAM sequence: GGG
cacaggatagggcagagaca

SEQ ID NO: 11117 - DNA, 20 bp, Artificial Sequence
  Description of Artificial Sequence: Synthetic oligonucleotide
  Target: AGXT; (+) strand; PAM type: NRG; PAM sequence: GAG
caggatagggcagagacagg

SEQ ID NO: 11118 - DNA, 20 bp, Artificial Sequence
  Description of Artificial Sequence: Synthetic oligonucleotide
  Target: AGXT; (+) strand; PAM type: NRG; PAM sequence: AGG
aggatagggcagagacaggg

SEQ ID NO: 11119 - DNA, 20 bp, Artificial Sequence
  Description of Artificial Sequence: Synthetic oligonucleotide
  Target: AGXT; (+) strand; PAM type: NRG; PAM sequence: GGG
ggatagggcagagacaggga

SEQ ID NO: 11120 - DNA, 20 bp, Artificial Sequence
  Description of Artificial Sequence: Synthetic oligonucleotide
  Target: AGXT; (+) strand; PAM type: NRG; PAM sequence: GGG
gatagggcagagacagggag

SEQ ID NO: 11121 - DNA, 20 bp, Artificial Sequence
  Description of Artificial Sequence: Synthetic oligonucleotide
  Target: AGXT; (+) strand; PAM type: NRG; PAM sequence: GGG
atagggcagagacagggagg

SEQ ID NO: 11122 - DNA, 20 bp, Artificial Sequence
  Description of Artificial Sequence: Synthetic oligonucleotide
  Target: AGXT; (+) strand; PAM type: NRG; PAM sequence: GAG
ggcagagacagggagggggt

SEQ ID NO: 11123 - DNA, 20 bp, Artificial Sequence
  Description of Artificial Sequence: Synthetic oligonucleotide
  Target: AGXT; (+) strand; PAM type: NRG; PAM sequence: AGG
gcagagacagggagggggtg

SEQ ID NO: 11124 - DNA, 20 bp, Artificial Sequence
  Description of Artificial Sequence: Synthetic oligonucleotide
  Target: AGXT; (+) strand; PAM type: NRG; PAM sequence: GGG
cagagacagggagggggtga

SEQ ID NO: 11125 - DNA, 20 bp, Artificial Sequence
  Description of Artificial Sequence: Synthetic oligonucleotide
  Target: AGXT; (+) strand; PAM type: NRG; PAM sequence: TGG
gggggtgagggcctgattcc

SEQ ID NO: 11126 - DNA, 20 bp, Artificial Sequence
  Description of Artificial Sequence: Synthetic oligonucleotide
  Target: AGXT; (+) strand; PAM type: NRG; PAM sequence: GAG
gggtgagggcctgattcctg

SEQ ID NO: 11127 - DNA, 20 bp, Artificial Sequence
  Description of Artificial Sequence: Synthetic oligonucleotide
  Target: AGXT; (+) strand; PAM type: NRG; PAM sequence: CAG
ggcctgattcctggagtccc

SEQ ID NO: 11128 - DNA, 20 bp, Artificial Sequence
  Description of Artificial Sequence: Synthetic oligonucleotide
  Target: AGXT; (+) strand; PAM type: NRG; PAM sequence: CAG
cctggagtccccagctccaa

SEQ ID NO: 11129 - DNA, 20 bp, Artificial Sequence
  Description of Artificial Sequence: Synthetic oligonucleotide
  Target: AGXT; (+) strand; PAM type: NRG; PAM sequence: GAG
tggagtccccagctccaaca

SEQ ID NO: 11130 - DNA, 20 bp, Artificial Sequence
  Description of Artificial Sequence: Synthetic oligonucleotide
  Target: AGXT; (+) strand; PAM type: NRG; PAM sequence: AGG
ggagtccccagctccaacag

SEQ ID NO: 11131 - DNA, 20 bp, Artificial Sequence
  Description of Artificial Sequence: Synthetic oligonucleotide
  Target: AGXT; (+) strand; PAM type: NRG; PAM sequence: AAG
ccccagctccaacagaggtc

SEQ ID NO: 11132 - DNA, 20 bp, Artificial Sequence
  Description of Artificial Sequence: Synthetic oligonucleotide
  Target: AGXT; (+) strand; PAM type: NRG; PAM sequence: AGG
cccagctccaacagaggtca

SEQ ID NO: 11133 - DNA, 20 bp, Artificial Sequence
  Description of Artificial Sequence: Synthetic oligonucleotide
  Target: AGXT; (+) strand; PAM type: NRG; PAM sequence: CAG
ctcactcacccctcatcctt

SEQ ID NO: 11134 - DNA, 20 bp, Artificial Sequence
  Description of Artificial Sequence: Synthetic oligonucleotide
  Target: AGXT; (+) strand; PAM type: NRG; PAM sequence: TGG
tctgtcatccatcacacctg

SEQ ID NO: 11135 - DNA, 20 bp, Artificial Sequence
  Description of Artificial Sequence: Synthetic oligonucleotide
  Target: AGXT; (+) strand; PAM type: NRG; PAM sequence: CAG
ccatcacacctgtggtgtgc

SEQ ID NO: 11136 - DNA, 20 bp, Artificial Sequence
  Description of Artificial Sequence: Synthetic oligonucleotide
  Target: AGXT; (+) strand; PAM type: NRG; PAM sequence: TGG
cacctgtggtgtgccagccc

SEQ ID NO: 11137 - DNA, 20 bp, Artificial Sequence
  Description of Artificial Sequence: Synthetic oligonucleotide
  Target: AGXT; (+) strand; PAM type: NRG; PAM sequence: CAG
gtggtgtgccagccctggac

SEQ ID NO: 11138 - DNA, 20 bp, Artificial Sequence
  Description of Artificial Sequence: Synthetic oligonucleotide
  Target: AGXT; (+) strand; PAM type: NRG; PAM sequence: AGG
tggtgtgccagccctggacc

SEQ ID NO: 11139 - DNA, 20 bp, Artificial Sequence
  Description of Artificial Sequence: Synthetic oligonucleotide
  Target: AGXT; (+) strand; PAM type: NRG; PAM sequence: CAG
accaggtacactctttgtgc

SEQ ID NO: 11140 - DNA, 20 bp, Artificial Sequence
  Description of Artificial Sequence: Synthetic oligonucleotide
  Target: AGXT; (+) strand; PAM type: NRG; PAM sequence: TGG
tacactctttgtgccagccc

SEQ ID NO: 11141 - DNA, 20 bp, Artificial Sequence
  Description of Artificial Sequence: Synthetic oligonucleotide
  Target: AGXT; (+) strand; PAM type: NRG; PAM sequence: GGG
acactctttgtgccagccct

SEQ ID NO: 11142 - DNA, 20 bp, Artificial Sequence
  Description of Artificial Sequence: Synthetic oligonucleotide
  Target: AGXT; (+) strand; PAM type: NRG; PAM sequence: CAG
tctttgtgccagccctgggc

SEQ ID NO: 11143 - DNA, 20 bp, Artificial Sequence
  Description of Artificial Sequence: Synthetic oligonucleotide
  Target: AGXT; (+) strand; PAM type: NRG; PAM sequence: AGG
ctttgtgccagccctgggcc

SEQ ID NO: 11144 - DNA, 20 bp, Artificial Sequence
  Description of Artificial Sequence: Synthetic oligonucleotide
  Target: AGXT; (+) strand; PAM type: NRG; PAM sequence: CAG
tgccagccctgggccaggtg

SEQ ID NO: 11145 - DNA, 20 bp, Artificial Sequence
  Description of Artificial Sequence: Synthetic oligonucleotide
  Target: AGXT; (+) strand; PAM type: NRG; PAM sequence: CGG
ccaggtgcagccctgactcc

SEQ ID NO: 11146 - DNA, 20 bp, Artificial Sequence
  Description of Artificial Sequence: Synthetic oligonucleotide
  Target: AGXT; (+) strand; PAM type: NRG; PAM sequence: GGG
caggtgcagccctgactccc

SEQ ID NO: 11147 - DNA, 20 bp, Artificial Sequence
  Description of Artificial Sequence: Synthetic oligonucleotide
  Target: AGXT; (+) strand; PAM type: NRG; PAM sequence: GAG
ggtgcagccctgactcccgg

SEQ ID NO: 11148 - DNA, 20 bp, Artificial Sequence
  Description of Artificial Sequence: Synthetic oligonucleotide
  Target: AGXT; (+) strand; PAM type: NRG; PAM sequence: TGG
ccgggagctcactctctgct

SEQ ID NO: 11149 - DNA, 20 bp, Artificial Sequence
  Description of Artificial Sequence: Synthetic oligonucleotide
  Target: AGXT; (+) strand; PAM type: NRG; PAM sequence: GGG
cgggagctcactctctgctt

SEQ ID NO: 11150 - DNA, 20 bp, Artificial Sequence
  Description of Artificial Sequence: Synthetic oligonucleotide
  Target: AGXT; (+) strand; PAM type: NRG; PAM sequence: GGG
gggagctcactctctgcttg

SEQ ID NO: 11151 - DNA, 20 bp, Artificial Sequence
  Description of Artificial Sequence: Synthetic oligonucleotide
  Target: AGXT; (+) strand; PAM type: NRG; PAM sequence: GAG
gagctcactctctgcttggg

SEQ ID NO: 11152 - DNA, 20 bp, Artificial Sequence
  Description of Artificial Sequence: Synthetic oligonucleotide
  Target: AGXT; (+) strand; PAM type: NRG; PAM sequence: AGG
agctcactctctgcttgggg

SEQ ID NO: 11153 - DNA, 20 bp, Artificial Sequence
  Description of Artificial Sequence: Synthetic oligonucleotide
  Target: AGXT; (+) strand; PAM type: NRG; PAM sequence: TGG
ctctctgcttggggaggcac

SEQ ID NO: 11154 - DNA, 20 bp, Artificial Sequence
  Description of Artificial Sequence: Synthetic oligonucleotide
  Target: AGXT; (+) strand; PAM type: NRG; PAM sequence: CAG
ctgcttggggaggcactggt

SEQ ID NO: 11155 - DNA, 20 bp, Artificial Sequence
  Description of Artificial Sequence: Synthetic oligonucleotide
  Target: AGXT; (+) strand; PAM type: NRG; PAM sequence: TGG
tggggaggcactggtcagtg

SEQ ID NO: 11156 - DNA, 20 bp, Artificial Sequence
  Description of Artificial Sequence: Synthetic oligonucleotide
  Target: AGXT; (+) strand; PAM type: NRG; PAM sequence: GAG
ggcactggtcagtgtggcct

SEQ ID NO: 11157 - DNA, 20 bp, Artificial Sequence
  Description of Artificial Sequence: Synthetic oligonucleotide
  Target: AGXT; (+) strand; PAM type: NRG; PAM sequence: AAG
ctggtcagtgtggcctgaga

SEQ ID NO: 11158 - DNA, 20 bp, Artificial Sequence
  Description of Artificial Sequence: Synthetic oligonucleotide
  Target: AGXT; (+) strand; PAM type: NRG; PAM sequence: AGG
tggtcagtgtggcctgagaa

SEQ ID NO: 11159 - DNA, 20 bp, Artificial Sequence
  Description of Artificial Sequence: Synthetic oligonucleotide
  Target: AGXT; (+) strand; PAM type: NRG; PAM sequence: GGG
ggtcagtgtggcctgagaaa

SEQ ID NO: 11160 - DNA, 20 bp, Artificial Sequence
  Description of Artificial Sequence: Synthetic oligonucleotide
  Target: AGXT; (+) strand; PAM type: NRG; PAM sequence: GAG
tggcctgagaaagggcattt

SEQ ID NO: 11161 - DNA, 20 bp, Artificial Sequence
  Description of Artificial Sequence: Synthetic oligonucleotide
  Target: AGXT; (+) strand; PAM type: NRG; PAM sequence: GAG
tgagaaagggcatttgagct

SEQ ID NO: 11162 - DNA, 20 bp, Artificial Sequence
  Description of Artificial Sequence: Synthetic oligonucleotide
  Target: AGXT; (+) strand; PAM type: NRG; PAM sequence: AAG
catttgagctgagctctgtc

SEQ ID NO: 11163 - DNA, 20 bp, Artificial Sequence
  Description of Artificial Sequence: Synthetic oligonucleotide
  Target: AGXT; (+) strand; PAM type: NRG; PAM sequence: GAG
tttgagctgagctctgtcaa

SEQ ID NO: 11164 - DNA, 20 bp, Artificial Sequence
  Description of Artificial Sequence: Synthetic oligonucleotide
  Target: AGXT; (+) strand; PAM type: NRG; PAM sequence: CAG
gagctctgtcaagagtgccc

SEQ ID NO: 11165 - DNA, 20 bp, Artificial Sequence
  Description of Artificial Sequence: Synthetic oligonucleotide
  Target: AGXT; (+) strand; PAM type: NRG; PAM sequence: AGG
agctctgtcaagagtgcccc

SEQ ID NO: 11166 - DNA, 20 bp, Artificial Sequence
  Description of Artificial Sequence: Synthetic oligonucleotide
  Target: AGXT; (+) strand; PAM type: NRG; PAM sequence: GAG
ctctgtcaagagtgccccag

SEQ ID NO: 11167 - DNA, 20 bp, Artificial Sequence
  Description of Artificial Sequence: Synthetic oligonucleotide
  Target: AGXT; (+) strand; PAM type: NRG; PAM sequence: TGG
caagagtgccccaggagcgt

SEQ ID NO: 11168 - DNA, 20 bp, Artificial Sequence
  Description of Artificial Sequence: Synthetic oligonucleotide
  Target: AGXT; (+) strand; PAM type: NRG; PAM sequence: CAG
cccaggagcgttggctccaa

SEQ ID NO: 11169 - DNA, 20 bp, Artificial Sequence
  Description of Artificial Sequence: Synthetic oligonucleotide
  Target: AGXT; (+) strand; PAM type: NRG; PAM sequence: CAG
aggagcgttggctccaacag

SEQ ID NO: 11170 - DNA, 20 bp, Artificial Sequence
  Description of Artificial Sequence: Synthetic oligonucleotide
  Target: AGXT; (+) strand; PAM type: NRG; PAM sequence: AGG
ggagcgttggctccaacagc

SEQ ID NO: 11171 - DNA, 20 bp, Artificial Sequence
  Description of Artificial Sequence: Synthetic oligonucleotide
  Target: AGXT; (+) strand; PAM type: NRG; PAM sequence: GGG
gagcgttggctccaacagca

SEQ ID NO: 11172 - DNA, 20 bp, Artificial Sequence
  Description of Artificial Sequence: Synthetic oligonucleotide
  Target: AGXT; (+) strand; PAM type: NRG; PAM sequence: GGG
agcgttggctccaacagcag

SEQ ID NO: 11173 - DNA, 20 bp, Artificial Sequence
  Description of Artificial Sequence: Synthetic oligonucleotide
  Target: AGXT; (+) strand; PAM type: NRG; PAM sequence: GGG
gcgttggctccaacagcagg

SEQ ID NO: 11174 - DNA, 20 bp, Artificial Sequence
  Description of Artificial Sequence: Synthetic oligonucleotide
  Target: AGXT; (+) strand; PAM type: NRG; PAM sequence: GGG
cgttggctccaacagcaggg

SEQ ID NO: 11175 - DNA, 20 bp, Artificial Sequence
  Description of Artificial Sequence: Synthetic oligonucleotide
  Target: AGXT; (+) strand; PAM type: NRG; PAM sequence: AAG
gctccaacagcaggggggtc

SEQ ID NO: 11176 - DNA, 20 bp, Artificial Sequence
  Description of Artificial Sequence: Synthetic oligonucleotide
  Target: AGXT; (+) strand; PAM type: NRG; PAM sequence: TGG
caacagcaggggggtcaaga

SEQ ID NO: 11177 - DNA, 20 bp, Artificial Sequence
  Description of Artificial Sequence: Synthetic oligonucleotide
  Target: AGXT; (+) strand; PAM type: NRG; PAM sequence: TGG
caggggggtcaagatggccc

SEQ ID NO: 11178 - DNA, 20 bp, Artificial Sequence
  Description of Artificial Sequence: Synthetic oligonucleotide
  Target: AGXT; (+) strand; PAM type: NRG; PAM sequence: CAG
gatggccctggctctacaca

SEQ ID NO: 11179 - DNA, 20 bp, Artificial Sequence
  Description of Artificial Sequence: Synthetic oligonucleotide
  Target: AGXT; (+) strand; PAM type: NRG; PAM sequence: GAG
tggccctggctctacacaca

SEQ ID NO: 11180 - DNA, 20 bp, Artificial Sequence
  Description of Artificial Sequence: Synthetic oligonucleotide
  Target: AGXT; (+) strand; PAM type: NRG; PAM sequence: GAG
gccctggctctacacacaga

SEQ ID NO: 11181 - DNA, 20 bp, Artificial Sequence
  Description of Artificial Sequence: Synthetic oligonucleotide
  Target: AGXT; (+) strand; PAM type: NRG; PAM sequence: AGG
ccctggctctacacacagag

SEQ ID NO: 11182 - DNA, 20 bp, Artificial Sequence
  Description of Artificial Sequence: Synthetic oligonucleotide
  Target: AGXT; (+) strand; PAM type: NRG; PAM sequence: TGG
acacacagagaggctctcat

SEQ ID NO: 11183 - DNA, 20 bp, Artificial Sequence
  Description of Artificial Sequence: Synthetic oligonucleotide
  Target: AGXT; (+) strand; PAM type: NRG; PAM sequence: GGG
cacacagagaggctctcatt

SEQ ID NO: 11184 - DNA, 20 bp, Artificial Sequence
  Description of Artificial Sequence: Synthetic oligonucleotide
  Target: AGXT; (+) strand; PAM type: NRG; PAM sequence: CAG
acagagaggctctcattggg

SEQ ID NO: 11185 - DNA, 20 bp, Artificial Sequence
  Description of Artificial Sequence: Synthetic oligonucleotide
  Target: AGXT; (+) strand; PAM type: NRG; PAM sequence: GAG
agagaggctctcattgggca

SEQ ID NO: 11186 - DNA, 20 bp, Artificial Sequence
  Description of Artificial Sequence: Synthetic oligonucleotide
  Target: AGXT; (+) strand; PAM type: NRG; PAM sequence: CAG
gcagagtccaccctcctctt

SEQ ID NO: 11187 - DNA, 20 bp, Artificial Sequence
  Description of Artificial Sequence: Synthetic oligonucleotide
  Target: AGXT; (+) strand; PAM type: NRG; PAM sequence: AGG
cagagtccaccctcctcttc

SEQ ID NO: 11188 - DNA, 20 bp, Artificial Sequence
  Description of Artificial Sequence: Synthetic oligonucleotide
  Target: AGXT; (+) strand; PAM type: NRG; PAM sequence: CAG
agtccaccctcctcttcagg

SEQ ID NO: 11189 - DNA, 20 bp, Artificial Sequence
  Description of Artificial Sequence: Synthetic oligonucleotide
  Target: AGXT; (+) strand; PAM type: NRG; PAM sequence: AGG
gtccaccctcctcttcaggc

SEQ ID NO: 11190 - DNA, 20 bp, Artificial Sequence
  Description of Artificial Sequence: Synthetic oligonucleotide
  Target: AGXT; (+) strand; PAM type: NRG; PAM sequence: CAG
caccctcctcttcaggcagg

SEQ ID NO: 11191 - DNA, 20 bp, Artificial Sequence
  Description of Artificial Sequence: Synthetic oligonucleotide
  Target: AGXT; (+) strand; PAM type: NRG; PAM sequence: CAG
ctcctcttcaggcaggcagc

SEQ ID NO: 11192 - DNA, 20 bp, Artificial Sequence
  Description of Artificial Sequence: Synthetic oligonucleotide
  Target: AGXT; (+) strand; PAM type: NRG; PAM sequence: AGG
tcctcttcaggcaggcagcc

SEQ ID NO: 11193 - DNA, 20 bp, Artificial Sequence
  Description of Artificial Sequence: Synthetic oligonucleotide
  Target: AGXT; (+) strand; PAM type: NRG; PAM sequence: GGG
cctcttcaggcaggcagcca

SEQ ID NO: 11194 - DNA, 20 bp, Artificial Sequence
  Description of Artificial Sequence: Synthetic oligonucleotide
  Target: AGXT; (+) strand; PAM type: NRG; PAM sequence: CGG
ggcaggcagccagggtgcca

SEQ ID NO: 11195 - DNA, 20 bp, Artificial Sequence
  Description of Artificial Sequence: Synthetic oligonucleotide
  Target: AGXT; (+) strand; PAM type: NRG; PAM sequence: TGG
aggcagccagggtgccacgg

SEQ ID NO: 11196 - DNA, 20 bp, Artificial Sequence
  Description of Artificial Sequence: Synthetic oligonucleotide
  Target: AGXT; (+) strand; PAM type: NRG; PAM sequence: GGG
ggcagccagggtgccacggt

SEQ ID NO: 11197 - DNA, 20 bp, Artificial Sequence
  Description of Artificial Sequence: Synthetic oligonucleotide
  Target: AGXT; (+) strand; PAM type: NRG; PAM sequence: TGG
agccagggtgccacggtggg

SEQ ID NO: 11198 - DNA, 20 bp, Artificial Sequence
  Description of Artificial Sequence: Synthetic oligonucleotide
  Target: AGXT; (+) strand; PAM type: NRG; PAM sequence: GGG
gccagggtgccacggtgggt

SEQ ID NO: 11199 - DNA, 20 bp, Artificial Sequence
  Description of Artificial Sequence: Synthetic oligonucleotide
  Target: AGXT; (+) strand; PAM type: NRG; PAM sequence: GGG
ccagggtgccacggtgggtg

SEQ ID NO: 11200 - DNA, 20 bp, Artificial Sequence
  Description of Artificial Sequence: Synthetic oligonucleotide
  Target: AGXT; (+) strand; PAM type: NRG; PAM sequence: CAG
gtgccacggtgggtggggtc

SEQ ID NO: 11201 - DNA, 20 bp, Artificial Sequence
  Description of Artificial Sequence: Synthetic oligonucleotide
  Target: AGXT; (+) strand; PAM type: NRG; PAM sequence: CAG
tgggtggggtccagccctca

SEQ ID NO: 11202 - DNA, 20 bp, Artificial Sequence
  Description of Artificial Sequence: Synthetic oligonucleotide
  Target: AGXT; (+) strand; PAM type: NRG; PAM sequence: AGG
gggtggggtccagccctcac

SEQ ID NO: 11203 - DNA, 20 bp, Artificial Sequence
  Description of Artificial Sequence: Synthetic oligonucleotide
  Target: AGXT; (+) strand; PAM type: NRG; PAM sequence: GGG
ggtggggtccagccctcaca

SEQ ID NO: 11204 - DNA, 20 bp, Artificial Sequence
  Description of Artificial Sequence: Synthetic oligonucleotide
  Target: AGXT; (+) strand; PAM type: NRG; PAM sequence: CAG
agccctcacagggccctgct

SEQ ID NO: 11205 - DNA, 20 bp, Artificial Sequence
  Description of Artificial Sequence: Synthetic oligonucleotide
  Target: AGXT; (+) strand; PAM type: NRG; PAM sequence: CAG
cctcacagggccctgctcag

SEQ ID NO: 11206 - DNA, 20 bp, Artificial Sequence
  Description of Artificial Sequence: Synthetic oligonucleotide
  Target: AGXT; (+) strand; PAM type: NRG; PAM sequence: AGG
ctcacagggccctgctcagc

SEQ ID NO: 11207 - DNA, 20 bp, Artificial Sequence
  Description of Artificial Sequence: Synthetic oligonucleotide
  Target: AGXT; (+) strand; PAM type: NRG; PAM sequence: GGG
tcacagggccctgctcagca

SEQ ID NO: 11208 - DNA, 20 bp, Artificial Sequence
  Description of Artificial Sequence: Synthetic oligonucleotide
  Target: AGXT; (+) strand; PAM type: NRG; PAM sequence: CGG
ggccctgctcagcagggcca

SEQ ID NO: 11209 - DNA, 20 bp, Artificial Sequence
  Description of Artificial Sequence: Synthetic oligonucleotide
  Target: AGXT; (+) strand; PAM type: NRG; PAM sequence: GGG
gccctgctcagcagggccac

SEQ ID NO: 11210 - DNA, 20 bp, Artificial Sequence
  Description of Artificial Sequence: Synthetic oligonucleotide
  Target: AGXT; (+) strand; PAM type: NRG; PAM sequence: TGG
gggccacgggtgcccaacac

SEQ ID NO: 11211 - DNA, 20 bp, Artificial Sequence
  Description of Artificial Sequence: Synthetic oligonucleotide
  Target: AGXT; (+) strand; PAM type: NRG; PAM sequence: CAG
gtgcccaacactggcttcta

SEQ ID NO: 11212 - DNA, 20 bp, Artificial Sequence
  Description of Artificial Sequence: Synthetic oligonucleotide
  Target: AGXT; (+) strand; PAM type: NRG; PAM sequence: CGG
actggcttctacagtgtgtg

SEQ ID NO: 11213 - DNA, 20 bp, Artificial Sequence
  Description of Artificial Sequence: Synthetic oligonucleotide
  Target: AGXT; (+) strand; PAM type: NRG; PAM sequence: GGG
ctggcttctacagtgtgtgc

SEQ ID NO: 11214 - DNA, 20 bp, Artificial Sequence
  Description of Artificial Sequence: Synthetic oligonucleotide
  Target: AGXT; (+) strand; PAM type: NRG; PAM sequence: CGG
cagtgtgtgcgggacactca

SEQ ID NO: 11215 - DNA, 20 bp, Artificial Sequence
  Description of Artificial Sequence: Synthetic oligonucleotide
  Target: AGXT; (+) strand; PAM type: NRG; PAM sequence: CAG
ggcccactctgtcctgcacc

SEQ ID NO: 11216 - DNA, 20 bp, Artificial Sequence
  Description of Artificial Sequence: Synthetic oligonucleotide
  Target: AGXT; (+) strand; PAM type: NRG; PAM sequence: AGG
gcccactctgtcctgcaccc

SEQ ID NO: 11217 - DNA, 20 bp, Artificial Sequence
  Description of Artificial Sequence: Synthetic oligonucleotide
  Target: AGXT; (+) strand; PAM type: NRG; PAM sequence: GAG
ccactctgtcctgcacccag

SEQ ID NO: 11218 - DNA, 20 bp, Artificial Sequence
  Description of Artificial Sequence: Synthetic oligonucleotide
  Target: AGXT; (+) strand; PAM type: NRG; PAM sequence: GAG
tgtcctgcacccaggagccc

SEQ ID NO: 11219 - DNA, 20 bp, Artificial Sequence
  Description of Artificial Sequence: Synthetic oligonucleotide
  Target: AGXT; (+) strand; PAM type: NRG; PAM sequence: AAG
cccgagtgcacccgatgacc

SEQ ID NO: 11220 - DNA, 20 bp, Artificial Sequence
  Description of Artificial Sequence: Synthetic oligonucleotide
  Target: AGXT; (+) strand; PAM type: NRG; PAM sequence: AGG
ccgagtgcacccgatgacca

SEQ ID NO: 11221 - DNA, 20 bp, Artificial Sequence
  Description of Artificial Sequence: Synthetic oligonucleotide
  Target: AGXT; (+) strand; PAM type: NRG; PAM sequence: TGG
cacccgatgaccaaggaccc

SEQ ID NO: 11222 - DNA, 20 bp, Artificial Sequence
  Description of Artificial Sequence: Synthetic oligonucleotide
  Target: AGXT; (+) strand; PAM type: NRG; PAM sequence: GAG
cccgatgaccaaggaccctg

SEQ ID NO: 11223 - DNA, 20 bp, Artificial Sequence
  Description of Artificial Sequence: Synthetic oligonucleotide
  Target: AGXT; (+) strand; PAM type: NRG; PAM sequence: AGG
ccgatgaccaaggaccctgg

SEQ ID NO: 11224 - DNA, 20 bp, Artificial Sequence
  Description of Artificial Sequence: Synthetic oligonucleotide
  Target: AGXT; (+) strand; PAM type: NRG; PAM sequence: CAG
ctggaggccactacacactg

SEQ ID NO: 11225 - DNA, 20 bp, Artificial Sequence
  Description of Artificial Sequence: Synthetic oligonucleotide
  Target: AGXT; (+) strand; PAM type: NRG; PAM sequence: AGG
tggaggccactacacactgc

SEQ ID NO: 11226 - DNA, 20 bp, Artificial Sequence
  Description of Artificial Sequence: Synthetic oligonucleotide
  Target: AGXT; (+) strand; PAM type: NRG; PAM sequence: GAG
gaggccactacacactgcag

SEQ ID NO: 11227 - DNA, 20 bp, Artificial Sequence
  Description of Artificial Sequence: Synthetic oligonucleotide
  Target: AGXT; (+) strand; PAM type: NRG; PAM sequence: AGG
aggccactacacactgcagg

SEQ ID NO: 11228 - DNA, 20 bp, Artificial Sequence
  Description of Artificial Sequence: Synthetic oligonucleotide
  Target: AGXT; (+) strand; PAM type: NRG; PAM sequence: TGG
ccactacacactgcaggagg

SEQ ID NO: 11229 - DNA, 20 bp, Artificial Sequence
  Description of Artificial Sequence: Synthetic oligonucleotide
  Target: AGXT; (+) strand; PAM type: NRG; PAM sequence: GAG
actacacactgcaggaggtg

SEQ ID NO: 11230 - DNA, 20 bp, Artificial Sequence
  Description of Artificial Sequence: Synthetic oligonucleotide
  Target: AGXT; (+) strand; PAM type: NRG; PAM sequence: AGG
ctacacactgcaggaggtgg

SEQ ID NO: 11231 - DNA, 20 bp, Artificial Sequence
  Description of Artificial Sequence: Synthetic oligonucleotide
  Target: AGXT; (+) strand; PAM type: NRG; PAM sequence: GAG
acacactgcaggaggtggag

SEQ ID NO: 11232 - DNA, 20 bp, Artificial Sequence
  Description of Artificial Sequence: Synthetic oligonucleotide
  Target: AGXT; (+) strand; PAM type: NRG; PAM sequence: AGG
cacactgcaggaggtggagg

SEQ ID NO: 11233 - DNA, 20 bp, Artificial Sequence
  Description of Artificial Sequence: Synthetic oligonucleotide
  Target: AGXT; (+) strand; PAM type: NRG; PAM sequence: TAG
actgcaggaggtggaggagg

SEQ ID NO: 11234 - DNA, 20 bp, Artificial Sequence
  Description of Artificial Sequence: Synthetic oligonucleotide
  Target: AGXT; (+) strand; PAM type: NRG; PAM sequence: AGG
ctgcaggaggtggaggaggt

SEQ ID NO: 11235 - DNA, 20 bp, Artificial Sequence
  Description of Artificial Sequence: Synthetic oligonucleotide
  Target: AGXT; (+) strand; PAM type: NRG; PAM sequence: GGG
tgcaggaggtggaggaggta

SEQ ID NO: 11236 - DNA, 20 bp, Artificial Sequence
  Description of Artificial Sequence: Synthetic oligonucleotide
  Target: AGXT; (+) strand; PAM type: NRG; PAM sequence: GGG
gcaggaggtggaggaggtag

SEQ ID NO: 11237 - DNA, 20 bp, Artificial Sequence
  Description of Artificial Sequence: Synthetic oligonucleotide
  Target: AGXT; (+) strand; PAM type: NRG; PAM sequence: CGG
ggtggaggaggtaggggacc

SEQ ID NO: 11238 - DNA, 20 bp, Artificial Sequence
  Description of Artificial Sequence: Synthetic oligonucleotide
  Target: AGXT; (+) strand; PAM type: NRG; PAM sequence: GGG
gtggaggaggtaggggaccc

SEQ ID NO: 11239 - DNA, 20 bp, Artificial Sequence
  Description of Artificial Sequence: Synthetic oligonucleotide
  Target: AGXT; (+) strand; PAM type: NRG; PAM sequence: GGG
tggaggaggtaggggacccg

SEQ ID NO: 11240 - DNA, 20 bp, Artificial Sequence
  Description of Artificial Sequence: Synthetic oligonucleotide
  Target: AGXT; (+) strand; PAM type: NRG; PAM sequence: TGG
aggaggtaggggacccgggg

SEQ ID NO: 11241 - DNA, 20 bp, Artificial Sequence
  Description of Artificial Sequence: Synthetic oligonucleotide
  Target: AGXT; (+) strand; PAM type: NRG; PAM sequence: GGG
ggaggtaggggacccggggt

SEQ ID NO: 11242 - DNA, 20 bp, Artificial Sequence
  Description of Artificial Sequence: Synthetic oligonucleotide
  Target: AGXT; (+) strand; PAM type: NRG; PAM sequence: GGG
gaggtaggggacccggggtg

SEQ ID NO: 11243 - DNA, 20 bp, Artificial Sequence
  Description of Artificial Sequence: Synthetic oligonucleotide
  Target: AGXT; (+) strand; PAM type: NRG; PAM sequence: GGG
aggtaggggacccggggtgg

SEQ ID NO: 11244 - DNA, 20 bp, Artificial Sequence
  Description of Artificial Sequence: Synthetic oligonucleotide
  Target: AGXT; (+) strand; PAM type: NRG; PAM sequence: CAG
aggggacccggggtgggggt

SEQ ID NO: 11245 - DNA, 20 bp, Artificial Sequence
  Description of Artificial Sequence: Synthetic oligonucleotide
  Target: AGXT; (+) strand; PAM type: NRG; PAM sequence: AGG
ggggacccggggtgggggtc

SEQ ID NO: 11246 - DNA, 20 bp, Artificial Sequence
  Description of Artificial Sequence: Synthetic oligonucleotide
  Target: AGXT; (+) strand; PAM type: NRG; PAM sequence: GGG
gggacccggggtgggggtca

SEQ ID NO: 11247 - DNA, 20 bp, Artificial Sequence
  Description of Artificial Sequence: Synthetic oligonucleotide
  Target: AGXT; (+) strand; PAM type: NRG; PAM sequence: CGG
cccggggtgggggtcagggc

SEQ ID NO: 11248 - DNA, 20 bp, Artificial Sequence
  Description of Artificial Sequence: Synthetic oligonucleotide
  Target: AGXT; (+) strand; PAM type: NRG; PAM sequence: GGG
ccggggtgggggtcagggcc

SEQ ID NO: 11249 - DNA, 20 bp, Artificial Sequence
  Description of Artificial Sequence: Synthetic oligonucleotide
  Target: AGXT; (+) strand; PAM type: NRG; PAM sequence: GAG
ggggtgggggtcagggccgg

SEQ ID NO: 11250 - DNA, 20 bp, Artificial Sequence
  Description of Artificial Sequence: Synthetic oligonucleotide
  Target: AGXT; (+) strand; PAM type: NRG; PAM sequence: AGG
gggtgggggtcagggccggg

SEQ ID NO: 11251 - DNA, 20 bp, Artificial Sequence
  Description of Artificial Sequence: Synthetic oligonucleotide
  Target: AGXT; (+) strand; PAM type: NRG; PAM sequence: GAG
gtgggggtcagggccgggag

SEQ ID NO: 11252 - DNA, 20 bp, Artificial Sequence
  Description of Artificial Sequence: Synthetic oligonucleotide
  Target: AGXT; (+) strand; PAM type: NRG; PAM sequence: AGG
tgggggtcagggccgggagg

SEQ ID NO: 11253 - DNA, 20 bp, Artificial Sequence
  Description of Artificial Sequence: Synthetic oligonucleotide
  Target: AGXT; (+) strand; PAM type: NRG; PAM sequence: TGG
gggtcagggccgggaggagg

SEQ ID NO: 11254 - DNA, 20 bp, Artificial Sequence
  Description of Artificial Sequence: Synthetic oligonucleotide
  Target: AGXT; (+) strand; PAM type: NRG; PAM sequence: GGG
ggtcagggccgggaggaggt

SEQ ID NO: 11255 - DNA, 20 bp, Artificial Sequence
  Description of Artificial Sequence: Synthetic oligonucleotide
  Target: AGXT; (+) strand; PAM type: NRG; PAM sequence: GAG
tcagggccgggaggaggtgg

SEQ ID NO: 11256 - DNA, 20 bp, Artificial Sequence
  Description of Artificial Sequence: Synthetic oligonucleotide
  Target: AGXT; (+) strand; PAM type: NRG; PAM sequence: TGG
gggccgggaggaggtgggag

SEQ ID NO: 11257 - DNA, 20 bp, Artificial Sequence
  Description of Artificial Sequence: Synthetic oligonucleotide
  Target: AGXT; (+) strand; PAM type: NRG; PAM sequence: GGG
ggccgggaggaggtgggagt

SEQ ID NO: 11258 - DNA, 20 bp, Artificial Sequence
  Description of Artificial Sequence: Synthetic oligonucleotide
  Target: AGXT; (+) strand; PAM type: NRG; PAM sequence: TGG
ggaggtgggagtgggcatgc

SEQ ID NO: 11259 - DNA, 20 bp, Artificial Sequence
  Description of Artificial Sequence: Synthetic oligonucleotide
  Target: AGXT; (+) strand; PAM type: NRG; PAM sequence: CAG
tgggagtgggcatgctggct

SEQ ID NO: 11260 - DNA, 20 bp, Artificial Sequence
  Description of Artificial Sequence: Synthetic oligonucleotide
  Target: AGXT; (+) strand; PAM type: NRG; PAM sequence: AGG
gggagtgggcatgctggctc

SEQ ID NO: 11261 - DNA, 20 bp, Artificial Sequence
  Description of Artificial Sequence: Synthetic oligonucleotide
  Target: AGXT; (+) strand; PAM type: NRG; PAM sequence: GGG
ggagtgggcatgctggctca

SEQ ID NO: 11262 - DNA, 20 bp, Artificial Sequence
  Description of Artificial Sequence: Synthetic oligonucleotide
  Target: AGXT; (+) strand; PAM type: NRG; PAM sequence: GGG
gagtgggcatgctggctcag

SEQ ID NO: 11263 - DNA, 20 bp, Artificial Sequence
  Description of Artificial Sequence: Synthetic oligonucleotide
  Target: AGXT; (+) strand; PAM type: NRG; PAM sequence: TGG
atgctggctcaggggctgcc

SEQ ID NO: 11264 - DNA, 20 bp, Artificial Sequence
  Description of Artificial Sequence: Synthetic oligonucleotide
  Target: AGXT; (+) strand; PAM type: NRG; PAM sequence: TGG
gctcaggggctgcctggaat

SEQ ID NO: 11265 - DNA, 20 bp, Artificial Sequence
  Description of Artificial Sequence: Synthetic oligonucleotide
  Target: AGXT; (+) strand; PAM type: NRG; PAM sequence: CAG
aggggctgcctggaattggc

SEQ ID NO: 11266 - DNA, 20 bp, Artificial Sequence
  Description of Artificial Sequence: Synthetic oligonucleotide
  Target: AGXT; (+) strand; PAM type: NRG; PAM sequence: CAG
gctgcctggaattggccagc

SEQ ID NO: 11267 - DNA, 20 bp, Artificial Sequence
  Description of Artificial Sequence: Synthetic oligonucleotide
  Target: AGXT; (+) strand; PAM type: NRG; PAM sequence: CAG
gcctggaattggccagccag

SEQ ID NO: 11268 - DNA, 20 bp, Artificial Sequence
  Description of Artificial Sequence: Synthetic oligonucleotide
  Target: AGXT; (+) strand; PAM type: NRG; PAM sequence: AGG
cctggaattggccagccagc

SEQ ID NO: 11269 - DNA, 20 bp, Artificial Sequence
  Description of Artificial Sequence: Synthetic oligonucleotide
  Target: AGXT; (+) strand; PAM type: NRG; PAM sequence: GGG
ctggaattggccagccagca

SEQ ID NO: 11270 - DNA, 20 bp, Artificial Sequence
  Description of Artificial Sequence: Synthetic oligonucleotide
  Target: AGXT; (+) strand; PAM type: NRG; PAM sequence: TGG
gaattggccagccagcaggg

SEQ ID NO: 11271 - DNA, 20 bp, Artificial Sequence
  Description of Artificial Sequence: Synthetic oligonucleotide
  Target: AGXT; (+) strand; PAM type: NRG; PAM sequence: GGG
aattggccagccagcagggt

SEQ ID NO: 11272 - DNA, 20 bp, Artificial Sequence
  Description of Artificial Sequence: Synthetic oligonucleotide
  Target: AGXT; (+) strand; PAM type: NRG; PAM sequence: TGG
cagccagcagggtgggatca

SEQ ID NO: 11273 - DNA, 20 bp, Artificial Sequence
  Description of Artificial Sequence: Synthetic oligonucleotide
  Target: AGXT; (+) strand; PAM type: NRG; PAM sequence: CGG
cagcagggtgggatcatggc

SEQ ID NO: 11274 - DNA, 20 bp, Artificial Sequence
  Description of Artificial Sequence: Synthetic oligonucleotide
  Target: AGXT; (+) strand; PAM type: NRG; PAM sequence: GGG
agcagggtgggatcatggcc

SEQ ID NO: 11275 - DNA, 20 bp, Artificial Sequence
  Description of Artificial Sequence: Synthetic oligonucleotide
  Target: AGXT; (+) strand; PAM type: NRG; PAM sequence: GAG
cagggtgggatcatggccgg

SEQ ID NO: 11276 - DNA, 20 bp, Artificial Sequence
  Description of Artificial Sequence: Synthetic oligonucleotide
  Target: AGXT; (+) strand; PAM type: NRG; PAM sequence: AGG
agggtgggatcatggccggg

SEQ ID NO: 11277 - DNA, 20 bp, Artificial Sequence
  Description of Artificial Sequence: Synthetic oligonucleotide
  Target: AGXT; (+) strand; PAM type: NRG; PAM sequence: TGG
tgggatcatggccgggaggc

SEQ ID NO: 11278 - DNA, 20 bp, Artificial Sequence
  Description of Artificial Sequence: Synthetic oligonucleotide
  Target: AGXT; (+) strand; PAM type: NRG; PAM sequence: TGG
gatcatggccgggaggctgg

SEQ ID NO: 11279 - DNA, 20 bp, Artificial Sequence
  Description of Artificial Sequence: Synthetic oligonucleotide
  Target: AGXT; (+) strand; PAM type: NRG; PAM sequence: CAG
ggaggctggtggctgaccct

SEQ ID NO: 11280 - DNA, 20 bp, Artificial Sequence
  Description of Artificial Sequence: Synthetic oligonucleotide
  Target: AGXT; (+) strand; PAM type: NRG; PAM sequence: TAG
ggctgaccctcagcccatcc

SEQ ID NO: 11281 - DNA, 20 bp, Artificial Sequence
  Description of Artificial Sequence: Synthetic oligonucleotide
  Target: AGXT; (+) strand; PAM type: NRG; PAM sequence: TGG
cctcagcccatcctagcatc

SEQ ID NO: 11282 - DNA, 20 bp, Artificial Sequence
  Description of Artificial Sequence: Synthetic oligonucleotide
  Target: AGXT; (+) strand; PAM type: NRG; PAM sequence: GAG
agcccatcctagcatctggt

SEQ ID NO: 11283 - DNA, 20 bp, Artificial Sequence
  Description of Artificial Sequence: Synthetic oligonucleotide
  Target: AGXT; (+) strand; PAM type: NRG; PAM sequence: CGG
ccatcctagcatctggtgag

SEQ ID NO: 11284 - DNA, 20 bp, Artificial Sequence
  Description of Artificial Sequence: Synthetic oligonucleotide
  Target: AGXT; (+) strand; PAM type: NRG; PAM sequence: CAG
tagcatctggtgagcggcca

SEQ ID NO: 11285 - DNA, 20 bp, Artificial Sequence
  Description of Artificial Sequence: Synthetic oligonucleotide
  Target: AGXT; (+) strand; PAM type: NRG; PAM sequence: AGG
agcatctggtgagcggccac

SEQ ID NO: 11286 - DNA, 20 bp, Artificial Sequence
  Description of Artificial Sequence: Synthetic oligonucleotide
  Target: AGXT; (+) strand; PAM type: NRG; PAM sequence: GGG
gcatctggtgagcggccaca

SEQ ID NO: 11287 - DNA, 20 bp, Artificial Sequence
  Description of Artificial Sequence: Synthetic oligonucleotide
  Target: AGXT; (+) strand; PAM type: NRG; PAM sequence: GGG
catctggtgagcggccacag

SEQ ID NO: 11288 - DNA, 20 bp, Artificial Sequence
  Description of Artificial Sequence: Synthetic oligonucleotide
  Target: AGXT; (+) strand; PAM type: NRG; PAM sequence: GAG
tctggtgagcggccacaggg

SEQ ID NO: 11289 - DNA, 20 bp, Artificial Sequence
  Description of Artificial Sequence: Synthetic oligonucleotide
  Target: AGXT; (+) strand; PAM type: NRG; PAM sequence: AGG
ctggtgagcggccacagggg

SEQ ID NO: 11290 - DNA, 20 bp, Artificial Sequence
  Description of Artificial Sequence: Synthetic oligonucleotide
  Target: AGXT; (+) strand; PAM type: NRG; PAM sequence: GGG
tggtgagcggccacagggga

SEQ ID NO: 11291 - DNA, 20 bp, Artificial Sequence
  Description of Artificial Sequence: Synthetic oligonucleotide
  Target: AGXT; (+) strand; PAM type: NRG; PAM sequence: TGG
caggggagggttccattacc

SEQ ID NO: 11292 - DNA, 20 bp, Artificial Sequence
  Description of Artificial Sequence: Synthetic oligonucleotide
  Target: AGXT; (+) strand; PAM type: NRG; PAM sequence: GGG
aggggagggttccattacct

SEQ ID NO: 11293 - DNA, 20 bp, Artificial Sequence
  Description of Artificial Sequence: Synthetic oligonucleotide
  Target: AGXT; (+) strand; PAM type: NRG; PAM sequence: TGG
agggttccattacctgggaa

SEQ ID NO: 11294 - DNA, 20 bp, Artificial Sequence
  Description of Artificial Sequence: Synthetic oligonucleotide
  Target: AGXT; (+) strand; PAM type: NRG; PAM sequence: TGG
gttccattacctgggaatgg

SEQ ID NO: 11295 - DNA, 20 bp, Artificial Sequence
  Description of Artificial Sequence: Synthetic oligonucleotide
  Target: AGXT; (+) strand; PAM type: NRG; PAM sequence: GGG
ttccattacctgggaatggt

SEQ ID NO: 11296 - DNA, 20 bp, Artificial Sequence
  Description of Artificial Sequence: Synthetic oligonucleotide
  Target: AGXT; (+) strand; PAM type: NRG; PAM sequence: AAG
cattacctgggaatggtggg

SEQ ID NO: 11297 - DNA, 20 bp, Artificial Sequence
  Description of Artificial Sequence: Synthetic oligonucleotide
  Target: AGXT; (+) strand; PAM type: NRG; PAM sequence: TGG
cctgggaatggtgggaagac

SEQ ID NO: 11298 - DNA, 20 bp, Artificial Sequence
  Description of Artificial Sequence: Synthetic oligonucleotide
  Target: AGXT; (+) strand; PAM type: NRG; PAM sequence: AAG
ggaatggtgggaagactggt

SEQ ID NO: 11299 - DNA, 20 bp, Artificial Sequence
  Description of Artificial Sequence: Synthetic oligonucleotide
  Target: AGXT; (+) strand; PAM type: NRG; PAM sequence: AGG
gaatggtgggaagactggta

SEQ ID NO: 11300 - DNA, 20 bp, Artificial Sequence
  Description of Artificial Sequence: Synthetic oligonucleotide
  Target: AGXT; (+) strand; PAM type: NRG; PAM sequence: GAG
atggtgggaagactggtaag

SEQ ID NO: 11301 - DNA, 20 bp, Artificial Sequence
  Description of Artificial Sequence: Synthetic oligonucleotide
  Target: AGXT; (+) strand; PAM type: NRG; PAM sequence: AGG
tggtgggaagactggtaagg

SEQ ID NO: 11302 - DNA, 20 bp, Artificial Sequence
  Description of Artificial Sequence: Synthetic oligonucleotide
  Target: AGXT; (+) strand; PAM type: NRG; PAM sequence: TGG
ctggtaaggaggcttctgtc

SEQ ID NO: 11303 - DNA, 20 bp, Artificial Sequence
  Description of Artificial Sequence: Synthetic oligonucleotide
  Target: AGXT; (+) strand; PAM type: NRG; PAM sequence: CAG
gtaaggaggcttctgtctgg

SEQ ID NO: 11304 - DNA, 20 bp, Artificial Sequence
  Description of Artificial Sequence: Synthetic oligonucleotide
  Target: AGXT; (+) strand; PAM type: NRG; PAM sequence: AGG
taaggaggcttctgtctggc

SEQ ID NO: 11305 - DNA, 20 bp, Artificial Sequence
  Description of Artificial Sequence: Synthetic oligonucleotide
  Target: AGXT; (+) strand; PAM type: NRG; PAM sequence: GGG
aaggaggcttctgtctggca

SEQ ID NO: 11306 - DNA, 20 bp, Artificial Sequence
  Description of Artificial Sequence: Synthetic oligonucleotide
  Target: AGXT; (+) strand; PAM type: NRG; PAM sequence: GAG
ttctgtctggcagggaaact

SEQ ID NO: 11307 - DNA, 20 bp, Artificial Sequence
  Description of Artificial Sequence: Synthetic oligonucleotide
  Target: AGXT; (+) strand; PAM type: NRG; PAM sequence: CAG
gtctggcagggaaactgagt

SEQ ID NO: 11308 - DNA, 20 bp, Artificial Sequence
  Description of Artificial Sequence: Synthetic oligonucleotide
  Target: AGXT; (+) strand; PAM type: NRG; PAM sequence: AGG
tctggcagggaaactgagtc

SEQ ID NO: 11309 - DNA, 20 bp, Artificial Sequence
  Description of Artificial Sequence: Synthetic oligonucleotide
  Target: AGXT; (+) strand; PAM type: NRG; PAM sequence: GAG
tggcagggaaactgagtcag

SEQ ID NO: 11310 - DNA, 20 bp, Artificial Sequence
  Description of Artificial Sequence: Synthetic oligonucleotide
  Target: AGXT; (+) strand; PAM type: NRG; PAM sequence: TGG
gggaaactgagtcaggagcc

SEQ ID NO: 11311 - DNA, 20 bp, Artificial Sequence
  Description of Artificial Sequence: Synthetic oligonucleotide
  Target: AGXT; (+) strand; PAM type: NRG; PAM sequence: TAG
gagtcaggagcctggtcctg

SEQ ID NO: 11312 - DNA, 20 bp, Artificial Sequence
  Description of Artificial Sequence: Synthetic oligonucleotide
  Target: AGXT; (+) strand; PAM type: NRG; PAM sequence: AGG
agtcaggagcctggtcctgt

SEQ ID NO: 11313 - DNA, 20 bp, Artificial Sequence
  Description of Artificial Sequence: Synthetic oligonucleotide
  Target: AGXT; (+) strand; PAM type: NRG; PAM sequence: CAG
caggagcctggtcctgtagg

SEQ ID NO: 11314 - DNA, 20 bp, Artificial Sequence
  Description of Artificial Sequence: Synthetic oligonucleotide
  Target: AGXT; (+) strand; PAM type: NRG; PAM sequence: AGG
aggagcctggtcctgtaggc

SEQ ID NO: 11315 - DNA, 20 bp, Artificial Sequence
  Description of Artificial Sequence: Synthetic oligonucleotide
  Target: AGXT; (+) strand; PAM type: NRG; PAM sequence: GGG
ggagcctggtcctgtaggca

SEQ ID NO: 11316 - DNA, 20 bp, Artificial Sequence
  Description of Artificial Sequence: Synthetic oligonucleotide
  Target: AGXT; (+) strand; PAM type: NRG; PAM sequence: CAG
cctggtcctgtaggcagggc

SEQ ID NO: 11317 - DNA, 20 bp, Artificial Sequence
  Description of Artificial Sequence: Synthetic oligonucleotide
  Target: AGXT; (+) strand; PAM type: NRG; PAM sequence: GAG
tggtcctgtaggcagggcca

SEQ ID NO: 11318 - DNA, 20 bp, Artificial Sequence
  Description of Artificial Sequence: Synthetic oligonucleotide
  Target: AGXT; (+) strand; PAM type: NRG; PAM sequence: GAG
gtcctgtaggcagggccaga

SEQ ID NO: 11319 - DNA, 20 bp, Artificial Sequence
  Description of Artificial Sequence: Synthetic oligonucleotide
  Target: AGXT; (+) strand; PAM type: NRG; PAM sequence: AGG
tcctgtaggcagggccagag

SEQ ID NO: 11320 - DNA, 20 bp, Artificial Sequence
  Description of Artificial Sequence: Synthetic oligonucleotide
  Target: AGXT; (+) strand; PAM type: NRG; PAM sequence: TGG
gtaggcagggccagagaggc

SEQ ID NO: 11321 - DNA, 20 bp, Artificial Sequence
  Description of Artificial Sequence: Synthetic oligonucleotide
  Target: AGXT; (+) strand; PAM type: NRG; PAM sequence: GAG
aggcagggccagagaggctg

SEQ ID NO: 11322 - DNA, 20 bp, Artificial Sequence
  Description of Artificial Sequence: Synthetic oligonucleotide
  Target: AGXT; (+) strand; PAM type: NRG; PAM sequence: AGG
ggcagggccagagaggctgg

SEQ ID NO: 11323 - DNA, 20 bp, Artificial Sequence
  Description of Artificial Sequence: Synthetic oligonucleotide
  Target: AGXT; (+) strand; PAM type: NRG; PAM sequence: CAG
agggccagagaggctggagg

SEQ ID NO: 11324 - DNA, 20 bp, Artificial Sequence
  Description of Artificial Sequence: Synthetic oligonucleotide
  Target: AGXT; (+) strand; PAM type: NRG; PAM sequence: AGG
gggccagagaggctggaggc

SEQ ID NO: 11325 - DNA, 20 bp, Artificial Sequence
  Description of Artificial Sequence: Synthetic oligonucleotide
  Target: AGXT; (+) strand; PAM type: NRG; PAM sequence: GAG
gccagagaggctggaggcag

SEQ ID NO: 11326 - DNA, 20 bp, Artificial Sequence
  Description of Artificial Sequence: Synthetic oligonucleotide
  Target: AGXT; (+) strand; PAM type: NRG; PAM sequence: AGG
ccagagaggctggaggcagg

SEQ ID NO: 11327 - DNA, 20 bp, Artificial Sequence
  Description of Artificial Sequence: Synthetic oligonucleotide
  Target: AGXT; (+) strand; PAM type: NRG; PAM sequence: GAG
gaggctggaggcaggaggcc

SEQ ID NO: 11328 - DNA, 20 bp, Artificial Sequence
  Description of Artificial Sequence: Synthetic oligonucleotide
  Target: AGXT; (+) strand; PAM type: NRG; PAM sequence: TGG
ctggaggcaggaggccgagt

SEQ ID NO: 11329 - DNA, 20 bp, Artificial Sequence
  Description of Artificial Sequence: Synthetic oligonucleotide
  Target: AGXT; (+) strand; PAM type: NRG; PAM sequence: GAG
ggaggcaggaggccgagttg

SEQ ID NO: 11330 - DNA, 20 bp, Artificial Sequence
  Description of Artificial Sequence: Synthetic oligonucleotide
  Target: AGXT; (+) strand; PAM type: NRG; PAM sequence: TAG
caggaggccgagttggagtc

SEQ ID NO: 11331 - DNA, 20 bp, Artificial Sequence
  Description of Artificial Sequence: Synthetic oligonucleotide
  Target: AGXT; (+) strand; PAM type: NRG; PAM sequence: AGG
aggaggccgagttggagtct

SEQ ID NO: 11332 - DNA, 20 bp, Artificial Sequence
  Description of Artificial Sequence: Synthetic oligonucleotide
  Target: AGXT; (+) strand; PAM type: NRG; PAM sequence: CAG
ccgagttggagtctaggctg

SEQ ID NO: 11333 - DNA, 20 bp, Artificial Sequence
  Description of Artificial Sequence: Synthetic oligonucleotide
  Target: AGXT; (+) strand; PAM type: NRG; PAM sequence: CAG
cagaacatgtccctgacact

SEQ ID NO: 11334 - DNA, 20 bp, Artificial Sequence
  Description of Artificial Sequence: Synthetic oligonucleotide
  Target: AGXT; (+) strand; PAM type: NRG; PAM sequence: AGG
agaacatgtccctgacactc

SEQ ID NO: 11335 - DNA, 20 bp, Artificial Sequence
  Description of Artificial Sequence: Synthetic oligonucleotide
  Target: AGXT; (+) strand; PAM type: NRG; PAM sequence: TGG
actcaggataccccaccctg

SEQ ID NO: 11336 - DNA, 20 bp, Artificial Sequence
  Description of Artificial Sequence: Synthetic oligonucleotide
  Target: AGXT; (+) strand; PAM type: NRG; PAM sequence: GGG
ctcaggataccccaccctgt

SEQ ID NO: 11337 - DNA, 20 bp, Artificial Sequence
  Description of Artificial Sequence: Synthetic oligonucleotide
  Target: AGXT; (+) strand; PAM type: NRG; PAM sequence: AAG
ataccccaccctgtgggctg

SEQ ID NO: 11338 - DNA, 20 bp, Artificial Sequence
  Description of Artificial Sequence: Synthetic oligonucleotide
  Target: AGXT; (+) strand; PAM type: NRG; PAM sequence: CAG
ctgtgggctgaagtcaacct

SEQ ID NO: 11339 - DNA, 20 bp, Artificial Sequence
  Description of Artificial Sequence: Synthetic oligonucleotide
  Target: AGXT; (+) strand; PAM type: NRG; PAM sequence: CGG
gaagtcaacctcagcctacc

SEQ ID NO: 11340 - DNA, 20 bp, Artificial Sequence
  Description of Artificial Sequence: Synthetic oligonucleotide
  Target: AGXT; (+) strand; PAM type: NRG; PAM sequence: GAG
agtcaacctcagcctacccg

SEQ ID NO: 11341 - DNA, 20 bp, Artificial Sequence
  Description of Artificial Sequence: Synthetic oligonucleotide
  Target: AGXT; (+) strand; PAM type: NRG; PAM sequence: TGG
acctcagcctacccggagtg

SEQ ID NO: 11342 - DNA, 20 bp, Artificial Sequence
  Description of Artificial Sequence: Synthetic oligonucleotide
  Target: AGXT; (+) strand; PAM type: NRG; PAM sequence: GGG
cctcagcctacccggagtgt

SEQ ID NO: 11343 - DNA, 20 bp, Artificial Sequence
  Description of Artificial Sequence: Synthetic oligonucleotide
  Target: AGXT; (+) strand; PAM type: NRG; PAM sequence: GGG
ctcagcctacccggagtgtg

SEQ ID NO: 11344 - DNA, 20 bp, Artificial Sequence
  Description of Artificial Sequence: Synthetic oligonucleotide
  Target: AGXT; (+) strand; PAM type: NRG; PAM sequence: CAG
ctacccggagtgtggggact

SEQ ID NO: 11345 - DNA, 20 bp, Artificial Sequence
  Description of Artificial Sequence: Synthetic oligonucleotide
  Target: AGXT; (+) strand; PAM type: NRG; PAM sequence: TAG
gtgtggggactcagtccatc

SEQ ID NO: 11346 - DNA, 20 bp, Artificial Sequence
  Description of Artificial Sequence: Synthetic oligonucleotide
  Target: AGXT; (+) strand; PAM type: NRG; PAM sequence: CAG
ggactcagtccatctagcaa

SEQ ID NO: 11347 - DNA, 20 bp, Artificial Sequence
  Description of Artificial Sequence: Synthetic oligonucleotide
  Target: AGXT; (+) strand; PAM type: NRG; PAM sequence: CAG
ccatctagcaacagccctca

SEQ ID NO: 11348 - DNA, 20 bp, Artificial Sequence
  Description of Artificial Sequence: Synthetic oligonucleotide
  Target: AGXT; (+) strand; PAM type: NRG; PAM sequence: AGG
catctagcaacagccctcac

SEQ ID NO: 11349 - DNA, 20 bp, Artificial Sequence
  Description of Artificial Sequence: Synthetic oligonucleotide
  Target: AGXT; (+) strand; PAM type: NRG; PAM sequence: CAG
tagcaacagccctcacaggc

SEQ ID NO: 11350 - DNA, 20 bp, Artificial Sequence
  Description of Artificial Sequence: Synthetic oligonucleotide
  Target: AGXT; (+) strand; PAM type: NRG; PAM sequence: AGG
agcaacagccctcacaggcc

SEQ ID NO: 11351 - DNA, 20 bp, Artificial Sequence
  Description of Artificial Sequence: Synthetic oligonucleotide
  Target: AGXT; (+) strand; PAM type: NRG; PAM sequence: CAG
agccctcacaggccaggcaa

SEQ ID NO: 11352 - DNA, 20 bp, Artificial Sequence
  Description of Artificial Sequence: Synthetic oligonucleotide
  Target: AGXT; (+) strand; PAM type: NRG; PAM sequence: AGG
gccctcacaggccaggcaac

SEQ ID NO: 11353 - DNA, 20 bp, Artificial Sequence
  Description of Artificial Sequence: Synthetic oligonucleotide
  Target: AGXT; (+) strand; PAM type: NRG; PAM sequence: TGG
tcacaggccaggcaacaggc

SEQ ID NO: 11354 - DNA, 20 bp, Artificial Sequence
  Description of Artificial Sequence: Synthetic oligonucleotide
  Target: AGXT; (+) strand; PAM type: NRG; PAM sequence: GGG
cacaggccaggcaacaggct

SEQ ID NO: 11355 - DNA, 20 bp, Artificial Sequence
  Description of Artificial Sequence: Synthetic oligonucleotide
  Target: AGXT; (+) strand; PAM type: NRG; PAM sequence: GGG
acaggccaggcaacaggctg

SEQ ID NO: 11356 - DNA, 20 bp, Artificial Sequence
  Description of Artificial Sequence: Synthetic oligonucleotide
  Target: AGXT; (+) strand; PAM type: NRG; PAM sequence: GGG
caggccaggcaacaggctgg

SEQ ID NO: 11357 - DNA, 20 bp, Artificial Sequence
  Description of Artificial Sequence: Synthetic oligonucleotide
  Target: AGXT; (+) strand; PAM type: NRG; PAM sequence: AAG
cctcctccatctctgcacca

SEQ ID NO: 11358 - DNA, 20 bp, Artificial Sequence
  Description of Artificial Sequence: Synthetic oligonucleotide
  Target: AGXT; (+) strand; PAM type: NRG; PAM sequence: TGG
ctgcaccaaagtcctgttct

SEQ ID NO: 11359 - DNA, 20 bp, Artificial Sequence
  Description of Artificial Sequence: Synthetic oligonucleotide
  Target: AGXT; (+) strand; PAM type: NRG; PAM sequence: AAG
ccaaagtcctgttcttggaa

SEQ ID NO: 11360 - DNA, 20 bp, Artificial Sequence
  Description of Artificial Sequence: Synthetic oligonucleotide
  Target: AGXT; (+) strand; PAM type: NRG; PAM sequence: CGG
tcttggaaaagcccttgtcc

SEQ ID NO: 11361 - DNA, 20 bp, Artificial Sequence
  Description of Artificial Sequence: Synthetic oligonucleotide
  Target: AGXT; (+) strand; PAM type: NRG; PAM sequence: GAG
ttggaaaagcccttgtcccg

SEQ ID NO: 11362 - DNA, 20 bp, Artificial Sequence
  Description of Artificial Sequence: Synthetic oligonucleotide
  Target: AGXT; (+) strand; PAM type: NRG; PAM sequence: CGG
gaaaagcccttgtcccggag

SEQ ID NO: 11363 - DNA, 20 bp, Artificial Sequence
  Description of Artificial Sequence: Synthetic oligonucleotide
  Target: AGXT; (+) strand; PAM type: NRG; PAM sequence: GAG
aaagcccttgtcccggagcg

SEQ ID NO: 11364 - DNA, 20 bp, Artificial Sequence
  Description of Artificial Sequence: Synthetic oligonucleotide
  Target: AGXT; (+) strand; PAM type: NRG; PAM sequence: CAG
gtcccggagcggagatgccc

SEQ ID NO: 11365 - DNA, 20 bp, Artificial Sequence
  Description of Artificial Sequence: Synthetic oligonucleotide
  Target: AGXT; (+) strand; PAM type: NRG; PAM sequence: CAG
cctcctcccatgcacaccat

SEQ ID NO: 11366 - DNA, 20 bp, Artificial Sequence
  Description of Artificial Sequence: Synthetic oligonucleotide
  Target: AGXT; (+) strand; PAM type: NRG; PAM sequence: AGG
ctcctcccatgcacaccatc

SEQ ID NO: 11367 - DNA, 20 bp, Artificial Sequence
  Description of Artificial Sequence: Synthetic oligonucleotide
  Target: AGXT; (+) strand; PAM type: NRG; PAM sequence: GGG
tcctcccatgcacaccatca

SEQ ID NO: 11368 - DNA, 20 bp, Artificial Sequence
  Description of Artificial Sequence: Synthetic oligonucleotide
  Target: AGXT; (+) strand; PAM type: NRG; PAM sequence: GAG
ctcccatgcacaccatcagg

SEQ ID NO: 11369 - DNA, 20 bp, Artificial Sequence
  Description of Artificial Sequence: Synthetic oligonucleotide
  Target: AGXT; (+) strand; PAM type: NRG; PAM sequence: AGG
tcccatgcacaccatcaggg

SEQ ID NO: 11370 - DNA, 20 bp, Artificial Sequence
  Description of Artificial Sequence: Synthetic oligonucleotide
  Target: AGXT; (+) strand; PAM type: NRG; PAM sequence: GAG
ccatgcacaccatcagggag

SEQ ID NO: 11371 - DNA, 20 bp, Artificial Sequence
  Description of Artificial Sequence: Synthetic oligonucleotide
  Target: AGXT; (+) strand; PAM type: NRG; PAM sequence: TAG
tgcacaccatcagggaggag

SEQ ID NO: 11372 - DNA, 20 bp, Artificial Sequence
  Description of Artificial Sequence: Synthetic oligonucleotide
  Target: AGXT; (+) strand; PAM type: NRG; PAM sequence: GAG
cacaccatcagggaggagta

SEQ ID NO: 11373 - DNA, 20 bp, Artificial Sequence
  Description of Artificial Sequence: Synthetic oligonucleotide
  Target: AGXT; (+) strand; PAM type: NRG; PAM sequence: AGG
acaccatcagggaggagtag

SEQ ID NO: 11374 - DNA, 20 bp, Artificial Sequence
  Description of Artificial Sequence: Synthetic oligonucleotide
  Target: AGXT; (+) strand; PAM type: NRG; PAM sequence: CAG
ccatcagggaggagtagagg

SEQ ID NO: 11375 - DNA, 20 bp, Artificial Sequence
  Description of Artificial Sequence: Synthetic oligonucleotide
  Target: AGXT; (+) strand; PAM type: NRG; PAM sequence: AGG
catcagggaggagtagaggc

SEQ ID NO: 11376 - DNA, 20 bp, Artificial Sequence
  Description of Artificial Sequence: Synthetic oligonucleotide
  Target: AGXT; (+) strand; PAM type: NRG; PAM sequence: CAG
gggaggagtagaggcaggcc

SEQ ID NO: 11377 - DNA, 20 bp, Artificial Sequence
  Description of Artificial Sequence: Synthetic oligonucleotide
  Target: AGXT; (+) strand; PAM type: NRG; PAM sequence: TGG
caggcccagcccctgctacc

SEQ ID NO: 11378 - DNA, 20 bp, Artificial Sequence
  Description of Artificial Sequence: Synthetic oligonucleotide
  Target: AGXT; (+) strand; PAM type: NRG; PAM sequence: GAG
ggcccagcccctgctacctg

SEQ ID NO: 11379 - DNA, 20 bp, Artificial Sequence
  Description of Artificial Sequence: Synthetic oligonucleotide
  Target: AGXT; (+) strand; PAM type: NRG; PAM sequence: TGG
acctggagctgtgccaccca

SEQ ID NO: 11380 - DNA, 20 bp, Artificial Sequence
  Description of Artificial Sequence: Synthetic oligonucleotide
  Target: AGXT; (+) strand; PAM type: NRG; PAM sequence: GGG
cctggagctgtgccacccat

SEQ ID NO: 11381 - DNA, 20 bp, Artificial Sequence
  Description of Artificial Sequence: Synthetic oligonucleotide
  Target: AGXT; (+) strand; PAM type: NRG; PAM sequence: GGG
ctggagctgtgccacccatg

SEQ ID NO: 11382 - DNA, 20 bp, Artificial Sequence
  Description of Artificial Sequence: Synthetic oligonucleotide
  Target: AGXT; (+) strand; PAM type: NRG; PAM sequence: GGG
tggagctgtgccacccatgg

SEQ ID NO: 11383 - DNA, 20 bp, Artificial Sequence
  Description of Artificial Sequence: Synthetic oligonucleotide
  Target: AGXT; (+) strand; PAM type: NRG; PAM sequence: GGG
ggagctgtgccacccatggg

SEQ ID NO: 11384 - DNA, 20 bp, Artificial Sequence
  Description of Artificial Sequence: Synthetic oligonucleotide
  Target: AGXT; (+) strand; PAM type: NRG; PAM sequence: TGG
tgccacccatggggggtttg

SEQ ID NO: 11385 - DNA, 20 bp, Artificial Sequence
  Description of Artificial Sequence: Synthetic oligonucleotide
  Target: AGXT; (+) strand; PAM type: NRG; PAM sequence: GGG
gccacccatggggggtttgt

SEQ ID NO: 11386 - DNA, 20 bp, Artificial Sequence
  Description of Artificial Sequence: Synthetic oligonucleotide
  Target: AGXT; (+) strand; PAM type: NRG; PAM sequence: GGG
ccacccatggggggtttgtg

SEQ ID NO: 11387 - DNA, 20 bp, Artificial Sequence
  Description of Artificial Sequence: Synthetic oligonucleotide
  Target: AGXT; (+) strand; PAM type: NRG; PAM sequence: GGG
cacccatggggggtttgtgg

SEQ ID NO: 11388 - DNA, 20 bp, Artificial Sequence
  Description of Artificial Sequence: Synthetic oligonucleotide
  Target: AGXT; (+) strand; PAM type: NRG; PAM sequence: TGG
gggggtttgtgggggtgttc

SEQ ID NO: 11389 - DNA, 20 bp, Artificial Sequence
  Description of Artificial Sequence: Synthetic oligonucleotide
  Target: AGXT; (+) strand; PAM type: NRG; PAM sequence: GAG
gttctggcccctgcccctct

SEQ ID NO: 11390 - DNA, 20 bp, Artificial Sequence
  Description of Artificial Sequence: Synthetic oligonucleotide
  Target: AGXT; (+) strand; PAM type: NRG; PAM sequence: CAG
gcccctctgagctccaccca

SEQ ID NO: 11391 - DNA, 20 bp, Artificial Sequence
  Description of Artificial Sequence: Synthetic oligonucleotide
  Target: AGXT; (+) strand; PAM type: NRG; PAM sequence: CAG
cacagccgtccctgcttcct

SEQ ID NO: 11392 - DNA, 20 bp, Artificial Sequence
  Description of Artificial Sequence: Synthetic oligonucleotide
  Target: AGXT; (+) strand; PAM type: NRG; PAM sequence: AGG
acagccgtccctgcttcctc

SEQ ID NO: 11393 - DNA, 20 bp, Artificial Sequence
  Description of Artificial Sequence: Synthetic oligonucleotide
  Target: AGXT; (+) strand; PAM type: NRG; PAM sequence: GGG
cagccgtccctgcttcctca

SEQ ID NO: 11394 - DNA, 20 bp, Artificial Sequence
  Description of Artificial Sequence: Synthetic oligonucleotide
  Target: AGXT; (+) strand; PAM type: NRG; PAM sequence: TGG
gtccctgcttcctcagggcc

SEQ ID NO: 11395 - DNA, 20 bp, Artificial Sequence
  Description of Artificial Sequence: Synthetic oligonucleotide
  Target: AGXT; (+) strand; PAM type: NRG; PAM sequence: CAG
tgcttcctcagggcctggcc

SEQ ID NO: 11396 - DNA, 20 bp, Artificial Sequence
  Description of Artificial Sequence: Synthetic oligonucleotide
  Target: AGXT; (+) strand; PAM type: NRG; PAM sequence: AAG
ctcagggcctggcccagcac

SEQ ID NO: 11397 - DNA, 20 bp, Artificial Sequence
  Description of Artificial Sequence: Synthetic oligonucleotide
  Target: AGXT; (+) strand; PAM type: NRG; PAM sequence: CAG
gggcctggcccagcacaagc

SEQ ID NO: 11398 - DNA, 20 bp, Artificial Sequence
  Description of Artificial Sequence: Synthetic oligonucleotide
  Target: AGXT; (+) strand; PAM type: NRG; PAM sequence: CGG
gtgctgctgttcttaaccca

SEQ ID NO: 11399 - DNA, 20 bp, Artificial Sequence
  Description of Artificial Sequence: Synthetic oligonucleotide
  Target: AGXT; (+) strand; PAM type: NRG; PAM sequence: GGG
tgctgctgttcttaacccac

SEQ ID NO: 11400 - DNA, 20 bp, Artificial Sequence
  Description of Artificial Sequence: Synthetic oligonucleotide
  Target: AGXT; (+) strand; PAM type: NRG; PAM sequence: GGG
gctgctgttcttaacccacg

SEQ ID NO: 11401 - DNA, 20 bp, Artificial Sequence
  Description of Artificial Sequence: Synthetic oligonucleotide
  Target: AGXT; (+) strand; PAM type: NRG; PAM sequence: GAG
tgctgttcttaacccacggg

SEQ ID NO: 11402 - DNA, 20 bp, Artificial Sequence
  Description of Artificial Sequence: Synthetic oligonucleotide
  Target: AGXT; (+) strand; PAM type: NRG; PAM sequence: CGG
acccacggggagtcgtccac

SEQ ID NO: 11403 - DNA, 20 bp, Artificial Sequence
  Description of Artificial Sequence: Synthetic oligonucleotide
  Target: AGXT; (+) strand; PAM type: NRG; PAM sequence: CAG
agtcgtccaccggcgtgctg

SEQ ID NO: 11404 - DNA, 20 bp, Artificial Sequence
  Description of Artificial Sequence: Synthetic oligonucleotide
  Target: AGXT; (+) strand; PAM type: NRG; PAM sequence: TGG
ggcgtgctgcagccccttga

SEQ ID NO: 11405 - DNA, 20 bp, Artificial Sequence
  Description of Artificial Sequence: Synthetic oligonucleotide
  Target: AGXT; (+) strand; PAM type: NRG; PAM sequence: CGG
ctgcagccccttgatggctt

SEQ ID NO: 11406 - DNA, 20 bp, Artificial Sequence
  Description of Artificial Sequence: Synthetic oligonucleotide
  Target: AGXT; (+) strand; PAM type: NRG; PAM sequence: GGG
tgcagccccttgatggcttc

SEQ ID NO: 11407 - DNA, 20 bp, Artificial Sequence
  Description of Artificial Sequence: Synthetic oligonucleotide
  Target: AGXT; (+) strand; PAM type: NRG; PAM sequence: GGG
gcagccccttgatggcttcg

SEQ ID NO: 11408 - DNA, 20 bp, Artificial Sequence
  Description of Artificial Sequence: Synthetic oligonucleotide
  Target: AGXT; (+) strand; PAM type: NRG; PAM sequence: CAG
ggcttcggggaactctgcca

SEQ ID NO: 11409 - DNA, 20 bp, Artificial Sequence
  Description of Artificial Sequence: Synthetic oligonucleotide
  Target: AGXT; (+) strand; PAM type: NRG; PAM sequence: AGG
gcttcggggaactctgccac

SEQ ID NO: 11410 - DNA, 20 bp, Artificial Sequence
  Description of Artificial Sequence: Synthetic oligonucleotide
  Target: AGXT; (+) strand; PAM type: NRG; PAM sequence: GAG
cggggaactctgccacaggt

SEQ ID NO: 11411 - DNA, 20 bp, Artificial Sequence
  Description of Artificial Sequence: Synthetic oligonucleotide
  Target: AGXT; (+) strand; PAM type: NRG; PAM sequence: TGG
aactctgccacaggtgagcc

SEQ ID NO: 11412 - DNA, 20 bp, Artificial Sequence
  Description of Artificial Sequence: Synthetic oligonucleotide
  Target: AGXT; (+) strand; PAM type: NRG; PAM sequence: CAG
gccacaggtgagcctggccc

SEQ ID NO: 11413 - DNA, 20 bp, Artificial Sequence
  Description of Artificial Sequence: Synthetic oligonucleotide
  Target: AGXT; (+) strand; PAM type: NRG; PAM sequence: AGG
ccacaggtgagcctggcccc

SEQ ID NO: 11414 - DNA, 20 bp, Artificial Sequence
  Description of Artificial Sequence: Synthetic oligonucleotide
  Target: AGXT; (+) strand; PAM type: NRG; PAM sequence: GGG
cacaggtgagcctggcccca

SEQ ID NO: 11415 - DNA, 20 bp, Artificial Sequence
  Description of Artificial Sequence: Synthetic oligonucleotide
  Target: AGXT; (+) strand; PAM type: NRG; PAM sequence: CGG
aggtgagcctggccccaggg

SEQ ID NO: 11416 - DNA, 20 bp, Artificial Sequence
  Description of Artificial Sequence: Synthetic oligonucleotide
  Target: AGXT; (+) strand; PAM type: NRG; PAM sequence: TGG
tgagcctggccccagggcgg

SEQ ID NO: 11417 - DNA, 20 bp, Artificial Sequence
  Description of Artificial Sequence: Synthetic oligonucleotide
  Target: AGXT; (+) strand; PAM type: NRG; PAM sequence: TGG
ctggccccagggcggtggac

SEQ ID NO: 11418 - DNA, 20 bp, Artificial Sequence
  Description of Artificial Sequence: Synthetic oligonucleotide
  Target: AGXT; (+) strand; PAM type: NRG; PAM sequence: GAG
ggccccagggcggtggactg

SEQ ID NO: 11419 - DNA, 20 bp, Artificial Sequence
  Description of Artificial Sequence: Synthetic oligonucleotide
  Target: AGXT; (+) strand; PAM type: NRG; PAM sequence: CAG
cagggcggtggactggagca

SEQ ID NO: 11420 - DNA, 20 bp, Artificial Sequence
  Description of Artificial Sequence: Synthetic oligonucleotide
  Target: AGXT; (+) strand; PAM type: NRG; PAM sequence: CAG
cggtggactggagcacagct

SEQ ID NO: 11421 - DNA, 20 bp, Artificial Sequence
  Description of Artificial Sequence: Synthetic oligonucleotide
  Target: AGXT; (+) strand; PAM type: NRG; PAM sequence: GAG
gtggactggagcacagctca

SEQ ID NO: 11422 - DNA, 20 bp, Artificial Sequence
  Description of Artificial Sequence: Synthetic oligonucleotide
  Target: AGXT; (+) strand; PAM type: NRG; PAM sequence: CAG
actggagcacagctcagagc

SEQ ID NO: 11423 - DNA, 20 bp, Artificial Sequence
  Description of Artificial Sequence: Synthetic oligonucleotide
  Target: AGXT; (+) strand; PAM type: NRG; PAM sequence: AGG
ctggagcacagctcagagcc

SEQ ID NO: 11424 - DNA, 20 bp, Artificial Sequence
  Description of Artificial Sequence: Synthetic oligonucleotide
  Target: AGXT; (+) strand; PAM type: NRG; PAM sequence: TGG
cacagctcagagccaggcta

SEQ ID NO: 11425 - DNA, 20 bp, Artificial Sequence
  Description of Artificial Sequence: Synthetic oligonucleotide
  Target: AGXT; (+) strand; PAM type: NRG; PAM sequence: GGG
acagctcagagccaggctat

SEQ ID NO: 11426 - DNA, 20 bp, Artificial Sequence
  Description of Artificial Sequence: Synthetic oligonucleotide
  Target: AGXT; (+) strand; PAM type: NRG; PAM sequence: GGG
cagctcagagccaggctatg

SEQ ID NO: 11427 - DNA, 20 bp, Artificial Sequence
  Description of Artificial Sequence: Synthetic oligonucleotide
  Target: AGXT; (+) strand; PAM type: NRG; PAM sequence: GAG
gctcagagccaggctatggg

SEQ ID NO: 11428 - DNA, 20 bp, Artificial Sequence
  Description of Artificial Sequence: Synthetic oligonucleotide
  Target: AGXT; (+) strand; PAM type: NRG; PAM sequence: AGG
ctcagagccaggctatgggg

SEQ ID NO: 11429 - DNA, 20 bp, Artificial Sequence
  Description of Artificial Sequence: Synthetic oligonucleotide
  Target: AGXT; (+) strand; PAM type: NRG; PAM sequence: GGG
tcagagccaggctatgggga

SEQ ID NO: 11430 - DNA, 20 bp, Artificial Sequence
  Description of Artificial Sequence: Synthetic oligonucleotide
  Target: AGXT; (+) strand; PAM type: NRG; PAM sequence: GGG
cagagccaggctatggggag

SEQ ID NO: 11431 - DNA, 20 bp, Artificial Sequence
  Description of Artificial Sequence: Synthetic oligonucleotide
  Target: AGXT; (+) strand; PAM type: NRG; PAM sequence: TGG
agccaggctatggggagggg

SEQ ID NO: 11432 - DNA, 20 bp, Artificial Sequence
  Description of Artificial Sequence: Synthetic oligonucleotide
  Target: AGXT; (+) strand; PAM type: NRG; PAM sequence: GGG
gccaggctatggggaggggt

SEQ ID NO: 11433 - DNA, 20 bp, Artificial Sequence
  Description of Artificial Sequence: Synthetic oligonucleotide
  Target: AGXT; (+) strand; PAM type: NRG; PAM sequence: TGG
ctatggggaggggtgggcac

SEQ ID NO: 11434 - DNA, 20 bp, Artificial Sequence
  Description of Artificial Sequence: Synthetic oligonucleotide
  Target: AGXT; (+) strand; PAM type: NRG; PAM sequence: TGG
ggggtgggcactggtccctc

SEQ ID NO: 11435 - DNA, 20 bp, Artificial Sequence
  Description of Artificial Sequence: Synthetic oligonucleotide
  Target: AGXT; (+) strand; PAM type: NRG; PAM sequence: TGG
ccctctggtccttctgcccc

SEQ ID NO: 11436 - DNA, 20 bp, Artificial Sequence
  Description of Artificial Sequence: Synthetic oligonucleotide
  Target: AGXT; (+) strand; PAM type: NRG; PAM sequence: CAG
tctgcccctggtccccaccc

SEQ ID NO: 11437 - DNA, 20 bp, Artificial Sequence
  Description of Artificial Sequence: Synthetic oligonucleotide
  Target: AGXT; (+) strand; PAM type: NRG; PAM sequence: TGG
ccaccccagcctctgtcaca

SEQ ID NO: 11438 - DNA, 20 bp, Artificial Sequence
  Description of Artificial Sequence: Synthetic oligonucleotide
  Target: AGXT; (+) strand; PAM type: NRG; PAM sequence: TGG
ccagcctctgtcacatggta

SEQ ID NO: 11439 - DNA, 20 bp, Artificial Sequence
  Description of Artificial Sequence: Synthetic oligonucleotide
  Target: AGXT; (+) strand; PAM type: NRG; PAM sequence: GGG
cagcctctgtcacatggtat

SEQ ID NO: 11440 - DNA, 20 bp, Artificial Sequence
  Description of Artificial Sequence: Synthetic oligonucleotide
  Target: AGXT; (+) strand; PAM type: NRG; PAM sequence: GGG
agcctctgtcacatggtatg

SEQ ID NO: 11441 - DNA, 20 bp, Artificial Sequence
  Description of Artificial Sequence: Synthetic oligonucleotide
  Target: AGXT; (+) strand; PAM type: NRG; PAM sequence: CAG
ctgtcacatggtatggggtg

SEQ ID NO: 11442 - DNA, 20 bp, Artificial Sequence
  Description of Artificial Sequence: Synthetic oligonucleotide
  Target: AGXT; (+) strand; PAM type: NRG; PAM sequence: AGG
tgtcacatggtatggggtgc

SEQ ID NO: 11443 - DNA, 20 bp, Artificial Sequence
  Description of Artificial Sequence: Synthetic oligonucleotide
  Target: AGXT; (+) strand; PAM type: NRG; PAM sequence: CAG
tatggggtgcaggcacctcc

SEQ ID NO: 11444 - DNA, 20 bp, Artificial Sequence
  Description of Artificial Sequence: Synthetic oligonucleotide
  Target: AGXT; (+) strand; PAM type: NRG; PAM sequence: AGG
atggggtgcaggcacctccc

SEQ ID NO: 11445 - DNA, 20 bp, Artificial Sequence
  Description of Artificial Sequence: Synthetic oligonucleotide
  Target: AGXT; (+) strand; PAM type: NRG; PAM sequence: TGG
ctcccaggtcctctttgctc

SEQ ID NO: 11446 - DNA, 20 bp, Artificial Sequence
  Description of Artificial Sequence: Synthetic oligonucleotide
  Target: AGXT; (+) strand; PAM type: NRG; PAM sequence: GGG
tcccaggtcctctttgctct

SEQ ID NO: 11447 - DNA, 20 bp, Artificial Sequence
  Description of Artificial Sequence: Synthetic oligonucleotide
  Target: AGXT; (+) strand; PAM type: NRG; PAM sequence: GAG
ggtcctctttgctctgggct

SEQ ID NO: 11448 - DNA, 20 bp, Artificial Sequence
  Description of Artificial Sequence: Synthetic oligonucleotide
  Target: AGXT; (+) strand; PAM type: NRG; PAM sequence: AAG
tttgctctgggctgagtcta

SEQ ID NO: 11449 - DNA, 20 bp, Artificial Sequence
  Description of Artificial Sequence: Synthetic oligonucleotide
  Target: AGXT; (+) strand; PAM type: NRG; PAM sequence: CAG
gctgagtctaaagacaaccc

SEQ ID NO: 11450 - DNA, 20 bp, Artificial Sequence
  Description of Artificial Sequence: Synthetic oligonucleotide
  Target: AGXT; (+) strand; PAM type: NRG; PAM sequence: AGG
ctgagtctaaagacaacccc

SEQ ID NO: 11451 - DNA, 20 bp, Artificial Sequence
  Description of Artificial Sequence: Synthetic oligonucleotide
  Target: AGXT; (+) strand; PAM type: NRG; PAM sequence: CAG
ctaaagacaaccccaggtcc

SEQ ID NO: 11452 - DNA, 20 bp, Artificial Sequence
  Description of Artificial Sequence: Synthetic oligonucleotide
  Target: AGXT; (+) strand; PAM type: NRG; PAM sequence: AGG
taaagacaaccccaggtccc

SEQ ID NO: 11453 - DNA, 20 bp, Artificial Sequence
  Description of Artificial Sequence: Synthetic oligonucleotide
  Target: AGXT; (+) strand; PAM type: NRG; PAM sequence: GGG
aaagacaaccccaggtccca

SEQ ID NO: 11454 - DNA, 20 bp, Artificial Sequence
  Description of Artificial Sequence: Synthetic oligonucleotide
  Target: AGXT; (+) strand; PAM type: NRG; PAM sequence: CAG
gacaaccccaggtcccaggg

SEQ ID NO: 11455 - DNA, 20 bp, Artificial Sequence
  Description of Artificial Sequence: Synthetic oligonucleotide
  Target: AGXT; (+) strand; PAM type: NRG; PAM sequence: AGG
acaaccccaggtcccagggc

SEQ ID NO: 11456 - DNA, 20 bp, Artificial Sequence
  Description of Artificial Sequence: Synthetic oligonucleotide
  Target: AGXT; (+) strand; PAM type: NRG; PAM sequence: CAG
cccaggtcccagggcaggct

SEQ ID NO: 11457 - DNA, 20 bp, Artificial Sequence
  Description of Artificial Sequence: Synthetic oligonucleotide
  Target: AGXT; (+) strand; PAM type: NRG; PAM sequence: AGG
ccaggtcccagggcaggctc

SEQ ID NO: 11458 - DNA, 20 bp, Artificial Sequence
  Description of Artificial Sequence: Synthetic oligonucleotide
  Target: AGXT; (+) strand; PAM type: NRG; PAM sequence: TGG
gggcaggctcaggtgctccc

SEQ ID NO: 11459 - DNA, 20 bp, Artificial Sequence
  Description of Artificial Sequence: Synthetic oligonucleotide
  Target: AGXT; (+) strand; PAM type: NRG; PAM sequence: GAG
ggctcaggtgctccctggcc

SEQ ID NO: 11460 - DNA, 20 bp, Artificial Sequence
  Description of Artificial Sequence: Synthetic oligonucleotide
  Target: AGXT; (+) strand; PAM type: NRG; PAM sequence: TAG
tccctggccgagcgccccca

SEQ ID NO: 11461 - DNA, 20 bp, Artificial Sequence
  Description of Artificial Sequence: Synthetic oligonucleotide
  Target: AGXT; (+) strand; PAM type: NRG; PAM sequence: CAG
tgcccactgacctctgtccc

SEQ ID NO: 11462 - DNA, 20 bp, Artificial Sequence
  Description of Artificial Sequence: Synthetic oligonucleotide
  Target: AGXT; (+) strand; PAM type: NRG; PAM sequence: AGG
gcccactgacctctgtcccc

SEQ ID NO: 11463 - DNA, 20 bp, Artificial Sequence
  Description of Artificial Sequence: Synthetic oligonucleotide
  Target: AGXT; (+) strand; PAM type: NRG; PAM sequence: GGG
cccactgacctctgtcccca

SEQ ID NO: 11464 - DNA, 20 bp, Artificial Sequence
  Description of Artificial Sequence: Synthetic oligonucleotide
  Target: AGXT; (+) strand; PAM type: NRG; PAM sequence: AAG
gacctctgtccccagggctg

SEQ ID NO: 11465 - DNA, 20 bp, Artificial Sequence
  Description of Artificial Sequence: Synthetic oligonucleotide
  Target: AGXT; (+) strand; PAM type: NRG; PAM sequence: GAG
cctctgtccccagggctgaa

SEQ ID NO: 11466 - DNA, 20 bp, Artificial Sequence
  Description of Artificial Sequence: Synthetic oligonucleotide
  Target: AGXT; (+) strand; PAM type: NRG; PAM sequence: AGG
ctctgtccccagggctgaag

SEQ ID NO: 11467 - DNA, 20 bp, Artificial Sequence
  Description of Artificial Sequence: Synthetic oligonucleotide
  Target: AGXT; (+) strand; PAM type: NRG; PAM sequence: GGG
tctgtccccagggctgaaga

SEQ ID NO: 11468 - DNA, 20 bp, Artificial Sequence
  Description of Artificial Sequence: Synthetic oligonucleotide
  Target: AGXT; (+) strand; PAM type: NRG; PAM sequence: TGG
ccccagggctgaagagggct

SEQ ID NO: 11469 - DNA, 20 bp, Artificial Sequence
  Description of Artificial Sequence: Synthetic oligonucleotide
  Target: AGXT; (+) strand; PAM type: NRG; PAM sequence: CAG
gggctgaagagggcttggtg

SEQ ID NO: 11470 - DNA, 20 bp, Artificial Sequence
  Description of Artificial Sequence: Synthetic oligonucleotide
  Target: AGXT; (+) strand; PAM type: NRG; PAM sequence: CAG
tgcagacttccatatcttgc

SEQ ID NO: 11471 - DNA, 20 bp, Artificial Sequence
  Description of Artificial Sequence: Synthetic oligonucleotide
  Target: AGXT; (+) strand; PAM type: NRG; PAM sequence: AGG
gcagacttccatatcttgcc

SEQ ID NO: 11472 - DNA, 20 bp, Artificial Sequence
  Description of Artificial Sequence: Synthetic oligonucleotide
  Target: AGXT; (+) strand; PAM type: NRG; PAM sequence: GGG
cagacttccatatcttgcca

SEQ ID NO: 11473 - DNA, 20 bp, Artificial Sequence
  Description of Artificial Sequence: Synthetic oligonucleotide
  Target: AGXT; (+) strand; PAM type: NRG; PAM sequence: GAG
gcctgtccccacctcacccc

SEQ ID NO: 11474 - DNA, 20 bp, Artificial Sequence
  Description of Artificial Sequence: Synthetic oligonucleotide
  Target: AGXT; (+) strand; PAM type: NRG; PAM sequence: CAG
ccacctcaccccgagattgc

SEQ ID NO: 11475 - DNA, 20 bp, Artificial Sequence
  Description of Artificial Sequence: Synthetic oligonucleotide
  Target: AGXT; (+) strand; PAM type: NRG; PAM sequence: AGG
cacctcaccccgagattgcc

SEQ ID NO: 11476 - DNA, 20 bp, Artificial Sequence
  Description of Artificial Sequence: Synthetic oligonucleotide
  Target: AGXT; (+) strand; PAM type: NRG; PAM sequence: AAG
ccgagattgccaggacacta

SEQ ID NO: 11477 - DNA, 20 bp, Artificial Sequence
  Description of Artificial Sequence: Synthetic oligonucleotide
  Target: AGXT; (+) strand; PAM type: NRG; PAM sequence: CAG
tgccctccacttccctcctc

SEQ ID NO: 11478 - DNA, 20 bp, Artificial Sequence
  Description of Artificial Sequence: Synthetic oligonucleotide
  Target: AGXT; (+) strand; PAM type: NRG; PAM sequence: TGG
cagcctccctcatccccgca

SEQ ID NO: 11479 - DNA, 20 bp, Artificial Sequence
  Description of Artificial Sequence: Synthetic oligonucleotide
  Target: AGXT; (+) strand; PAM type: NRG; PAM sequence: GGG
agcctccctcatccccgcat

SEQ ID NO: 11480 - DNA, 20 bp, Artificial Sequence
  Description of Artificial Sequence: Synthetic oligonucleotide
  Target: AGXT; (+) strand; PAM type: NRG; PAM sequence: GGG
gcctccctcatccccgcatg

SEQ ID NO: 11481 - DNA, 20 bp, Artificial Sequence
  Description of Artificial Sequence: Synthetic oligonucleotide
  Target: AGXT; (+) strand; PAM type: NRG; PAM sequence: GGG
cctccctcatccccgcatgg

SEQ ID NO: 11482 - DNA, 20 bp, Artificial Sequence
  Description of Artificial Sequence: Synthetic oligonucleotide
  Target: AGXT; (+) strand; PAM type: NRG; PAM sequence: CAG
catccccgcatgggggtgca

SEQ ID NO: 11483 - DNA, 20 bp, Artificial Sequence
  Description of Artificial Sequence: Synthetic oligonucleotide
  Target: AGXT; (+) strand; PAM type: NRG; PAM sequence: AGG
atccccgcatgggggtgcac

SEQ ID NO: 11484 - DNA, 20 bp, Artificial Sequence
  Description of Artificial Sequence: Synthetic oligonucleotide
  Target: AGXT; (+) strand; PAM type: NRG; PAM sequence: GGG
tccccgcatgggggtgcaca

SEQ ID NO: 11485 - DNA, 20 bp, Artificial Sequence
  Description of Artificial Sequence: Synthetic oligonucleotide
  Target: AGXT; (+) strand; PAM type: NRG; PAM sequence: AAG
cgcatgggggtgcacagggc

SEQ ID NO: 11486 - DNA, 20 bp, Artificial Sequence
  Description of Artificial Sequence: Synthetic oligonucleotide
  Target: AGXT; (+) strand; PAM type: NRG; PAM sequence: AGG
gcatgggggtgcacagggca

SEQ ID NO: 11487 - DNA, 20 bp, Artificial Sequence
  Description of Artificial Sequence: Synthetic oligonucleotide
  Target: AGXT; (+) strand; PAM type: NRG; PAM sequence: TGG
gcacagggcaaggccttgaa

SEQ ID NO: 11488 - DNA, 20 bp, Artificial Sequence
  Description of Artificial Sequence: Synthetic oligonucleotide
  Target: AGXT; (+) strand; PAM type: NRG; PAM sequence: GAG
acagggcaaggccttgaatg

SEQ ID NO: 11489 - DNA, 20 bp, Artificial Sequence
  Description of Artificial Sequence: Synthetic oligonucleotide
  Target: AGXT; (+) strand; PAM type: NRG; PAM sequence: CAG
ggcaaggccttgaatggagt

SEQ ID NO: 11490 - DNA, 20 bp, Artificial Sequence
  Description of Artificial Sequence: Synthetic oligonucleotide
  Target: AGXT; (+) strand; PAM type: NRG; PAM sequence: TGG
aggccttgaatggagtcaga

SEQ ID NO: 11491 - DNA, 20 bp, Artificial Sequence
  Description of Artificial Sequence: Synthetic oligonucleotide
  Target: AGXT; (+) strand; PAM type: NRG; PAM sequence: GGG
ggccttgaatggagtcagat

SEQ ID NO: 11492 - DNA, 20 bp, Artificial Sequence
  Description of Artificial Sequence: Synthetic oligonucleotide
  Target: AGXT; (+) strand; PAM type: NRG; PAM sequence: GAG
tggagtcagatgggattcct

SEQ ID NO: 11493 - DNA, 20 bp, Artificial Sequence
  Description of Artificial Sequence: Synthetic oligonucleotide
  Target: AGXT; (+) strand; PAM type: NRG; PAM sequence: CGG
gatgggattcctgagaaatg

SEQ ID NO: 11494 - DNA, 20 bp, Artificial Sequence
  Description of Artificial Sequence: Synthetic oligonucleotide
  Target: AGXT; (+) strand; PAM type: NRG; PAM sequence: CAG
ggattcctgagaaatgcgga

SEQ ID NO: 11495 - DNA, 20 bp, Artificial Sequence
  Description of Artificial Sequence: Synthetic oligonucleotide
  Target: AGXT; (+) strand; PAM type: NRG; PAM sequence: GAG
attcctgagaaatgcggaca

SEQ ID NO: 11496 - DNA, 20 bp, Artificial Sequence
  Description of Artificial Sequence: Synthetic oligonucleotide
  Target: AGXT; (+) strand; PAM type: NRG; PAM sequence: TGG
gaaatgcggacagagcccct

SEQ ID NO: 11497 - DNA, 20 bp, Artificial Sequence
  Description of Artificial Sequence: Synthetic oligonucleotide
  Target: AGXT; (+) strand; PAM type: NRG; PAM sequence: GGG
aaatgcggacagagcccctt

SEQ ID NO: 11498 - DNA, 20 bp, Artificial Sequence
  Description of Artificial Sequence: Synthetic oligonucleotide
  Target: AGXT; (+) strand; PAM type: NRG; PAM sequence: CAG
ggacagagccccttgggacc

SEQ ID NO: 11499 - DNA, 20 bp, Artificial Sequence
  Description of Artificial Sequence: Synthetic oligonucleotide
  Target: AGXT; (+) strand; PAM type: NRG; PAM sequence: CAG
cagagccccttgggacccag

SEQ ID NO: 11500 - DNA, 20 bp, Artificial Sequence
  Description of Artificial Sequence: Synthetic oligonucleotide
  Target: AGXT; (+) strand; PAM type: NRG; PAM sequence: CAG
ggacccagcagtcccgtctg

SEQ ID NO: 11501 - DNA, 20 bp, Artificial Sequence
  Description of Artificial Sequence: Synthetic oligonucleotide
  Target: AGXT; (+) strand; PAM type: NRG; PAM sequence: AGG
gacccagcagtcccgtctgc

SEQ ID NO: 11502 - DNA, 20 bp, Artificial Sequence
  Description of Artificial Sequence: Synthetic oligonucleotide
  Target: AGXT; (+) strand; PAM type: NRG; PAM sequence: GAG
gcagtcccgtctgcaggtct

SEQ ID NO: 11503 - DNA, 20 bp, Artificial Sequence
  Description of Artificial Sequence: Synthetic oligonucleotide
  Target: AGXT; (+) strand; PAM type: NRG; PAM sequence: CAG
cccgtctgcaggtctgagca

SEQ ID NO: 11504 - DNA, 20 bp, Artificial Sequence
  Description of Artificial Sequence: Synthetic oligonucleotide
  Target: AGXT; (+) strand; PAM type: NRG; PAM sequence: AGG
ccgtctgcaggtctgagcac

SEQ ID NO: 11505 - DNA, 20 bp, Artificial Sequence
  Description of Artificial Sequence: Synthetic oligonucleotide
  Target: AGXT; (+) strand; PAM type: NRG; PAM sequence: CAG
ctgcaggtctgagcacagga

SEQ ID NO: 11506 - DNA, 20 bp, Artificial Sequence
  Description of Artificial Sequence: Synthetic oligonucleotide
  Target: AGXT; (+) strand; PAM type: NRG; PAM sequence: GAG
gcaggtctgagcacaggaca

SEQ ID NO: 11507 - DNA, 20 bp, Artificial Sequence
  Description of Artificial Sequence: Synthetic oligonucleotide
  Target: AGXT; (+) strand; PAM type: NRG; PAM sequence: AGG
caggtctgagcacaggacag

SEQ ID NO: 11508 - DNA, 20 bp, Artificial Sequence
  Description of Artificial Sequence: Synthetic oligonucleotide
  Target: AGXT; (+) strand; PAM type: NRG; PAM sequence: GAG
ggtctgagcacaggacagag

SEQ ID NO: 11509 - DNA, 20 bp, Artificial Sequence
  Description of Artificial Sequence: Synthetic oligonucleotide
  Target: AGXT; (+) strand; PAM type: NRG; PAM sequence: GAG
tctgagcacaggacagagga

SEQ ID NO: 11510 - DNA, 20 bp, Artificial Sequence
  Description of Artificial Sequence: Synthetic oligonucleotide
  Target: AGXT; (+) strand; PAM type: NRG; PAM sequence: CGG
gacagaggagagaaactcca

SEQ ID NO: 11511 - DNA, 20 bp, Artificial Sequence
  Description of Artificial Sequence: Synthetic oligonucleotide
  Target: AGXT; (+) strand; PAM type: NRG; PAM sequence: CAG
gaggagagaaactccacggc

SEQ ID NO: 11512 - DNA, 20 bp, Artificial Sequence
  Description of Artificial Sequence: Synthetic oligonucleotide
  Target: AGXT; (+) strand; PAM type: NRG; PAM sequence: AGG
aggagagaaactccacggcc

SEQ ID NO: 11513 - DNA, 20 bp, Artificial Sequence
  Description of Artificial Sequence: Synthetic oligonucleotide
  Target: AGXT; (+) strand; PAM type: NRG; PAM sequence: GGG
ggagagaaactccacggcca

SEQ ID NO: 11514 - DNA, 20 bp, Artificial Sequence
  Description of Artificial Sequence: Synthetic oligonucleotide
  Target: AGXT; (+) strand; PAM type: NRG; PAM sequence: GAG
agagaaactccacggccagg

SEQ ID NO: 11515 - DNA, 20 bp, Artificial Sequence
  Description of Artificial Sequence: Synthetic oligonucleotide
  Target: AGXT; (+) strand; PAM type: NRG; PAM sequence: AGG
gagaaactccacggccaggg

SEQ ID NO: 11516 - DNA, 20 bp, Artificial Sequence
  Description of Artificial Sequence: Synthetic oligonucleotide
  Target: AGXT; (+) strand; PAM type: NRG; PAM sequence: GGG
agaaactccacggccaggga

SEQ ID NO: 11517 - DNA, 20 bp, Artificial Sequence
  Description of Artificial Sequence: Synthetic oligonucleotide
  Target: AGXT; (+) strand; PAM type: NRG; PAM sequence: CAG
gccagggagggtccttctga

SEQ ID NO: 11518 - DNA, 20 bp, Artificial Sequence
  Description of Artificial Sequence: Synthetic oligonucleotide
  Target: AGXT; (+) strand; PAM type: NRG; PAM sequence: AGG
ccagggagggtccttctgac

SEQ ID NO: 11519 - DNA, 20 bp, Artificial Sequence
  Description of Artificial Sequence: Synthetic oligonucleotide
  Target: AGXT; (+) strand; PAM type: NRG; PAM sequence: GGG
cagggagggtccttctgaca

SEQ ID NO: 11520 - DNA, 20 bp, Artificial Sequence
  Description of Artificial Sequence: Synthetic oligonucleotide
  Target: AGXT; (+) strand; PAM type: NRG; PAM sequence: CAG
ggtccttctgacagggcccc

SEQ ID NO: 11521 - DNA, 20 bp, Artificial Sequence
  Description of Artificial Sequence: Synthetic oligonucleotide
  Target: AGXT; (+) strand; PAM type: NRG; PAM sequence: CAG
ttctgacagggcccccagcc

SEQ ID NO: 11522 - DNA, 20 bp, Artificial Sequence
  Description of Artificial Sequence: Synthetic oligonucleotide
  Target: AGXT; (+) strand; PAM type: NRG; PAM sequence: CAG
gacagggcccccagcccaga

SEQ ID NO: 11523 - DNA, 20 bp, Artificial Sequence
  Description of Artificial Sequence: Synthetic oligonucleotide
  Target: AGXT; (+) strand; PAM type: NRG; PAM sequence: TGG
agcccagacagcttgctgca

SEQ ID NO: 11524 - DNA, 20 bp, Artificial Sequence
  Description of Artificial Sequence: Synthetic oligonucleotide
  Target: AGXT; (+) strand; PAM type: NRG; PAM sequence: TGG
acagcttgctgcatggaccg

SEQ ID NO: 11525 - DNA, 20 bp, Artificial Sequence
  Description of Artificial Sequence: Synthetic oligonucleotide
  Target: AGXT; (+) strand; PAM type: NRG; PAM sequence: AAG
atggaccgtggccatgaata

SEQ ID NO: 11526 - DNA, 20 bp, Artificial Sequence
  Description of Artificial Sequence: Synthetic oligonucleotide
  Target: AGXT; (+) strand; PAM type: NRG; PAM sequence: TGG
taaagctcacaaacataacc

SEQ ID NO: 11527 - DNA, 20 bp, Artificial Sequence
  Description of Artificial Sequence: Synthetic oligonucleotide
  Target: AGXT; (+) strand; PAM type: NRG; PAM sequence: CAG
gctcacaaacataacctggc

SEQ ID NO: 11528 - DNA, 20 bp, Artificial Sequence
  Description of Artificial Sequence: Synthetic oligonucleotide
  Target: AGXT; (+) strand; PAM type: NRG; PAM sequence: CAG
aaacataacctggccagctt

SEQ ID NO: 11529 - DNA, 20 bp, Artificial Sequence
  Description of Artificial Sequence: Synthetic oligonucleotide
  Target: AGXT; (+) strand; PAM type: NRG; PAM sequence: CAG
tggccagcttcagcaacacc

SEQ ID NO: 11530 - DNA, 20 bp, Artificial Sequence
  Description of Artificial Sequence: Synthetic oligonucleotide
  Target: AGXT; (+) strand; PAM type: NRG; PAM sequence: AGG
ggccagcttcagcaacaccc

SEQ ID NO: 11531 - DNA, 20 bp, Artificial Sequence
  Description of Artificial Sequence: Synthetic oligonucleotide
  Target: AGXT; (+) strand; PAM type: NRG; PAM sequence: CGG
acccaggccatccccacctg

SEQ ID NO: 11532 - DNA, 20 bp, Artificial Sequence
  Description of Artificial Sequence: Synthetic oligonucleotide
  Target: AGXT; (+) strand; PAM type: NRG; PAM sequence: CAG
aggccatccccacctgcggc

SEQ ID NO: 11533 - DNA, 20 bp, Artificial Sequence
  Description of Artificial Sequence: Synthetic oligonucleotide
  Target: AGXT; (+) strand; PAM type: NRG; PAM sequence: GAG
tccccacctgcggccagcac

SEQ ID NO: 11534 - DNA, 20 bp, Artificial Sequence
  Description of Artificial Sequence: Synthetic oligonucleotide
  Target: AGXT; (+) strand; PAM type: NRG; PAM sequence: AAG
tgtgtctcttttttctttat

SEQ ID NO: 11535 - DNA, 20 bp, Artificial Sequence
  Description of Artificial Sequence: Synthetic oligonucleotide
  Target: AGXT; (+) strand; PAM type: NRG; PAM sequence: TGG
tttttctttataagaaaacc

SEQ ID NO: 11536 - DNA, 20 bp, Artificial Sequence
  Description of Artificial Sequence: Synthetic oligonucleotide
  Target: AGXT; (+) strand; PAM type: NRG; PAM sequence: GAG
tttctttataagaaaacctg

SEQ ID NO: 11537 - DNA, 20 bp, Artificial Sequence
  Description of Artificial Sequence: Synthetic oligonucleotide
  Target: AGXT; (+) strand; PAM type: NRG; PAM sequence: AGG
ttctttataagaaaacctgg

SEQ ID NO: 11538 - DNA, 20 bp, Artificial Sequence
  Description of Artificial Sequence: Synthetic oligonucleotide
  Target: AGXT; (+) strand; PAM type: NRG; PAM sequence: TGG
tttataagaaaacctggagg

SEQ ID NO: 11539 - DNA, 20 bp, Artificial Sequence
  Description of Artificial Sequence: Synthetic oligonucleotide
  Target: AGXT; (+) strand; PAM type: NRG; PAM sequence: GAG
tataagaaaacctggaggtg

SEQ ID NO: 11540 - DNA, 20 bp, Artificial Sequence
  Description of Artificial Sequence: Synthetic oligonucleotide
  Target: AGXT; (+) strand; PAM type: NRG; PAM sequence: AGG
ataagaaaacctggaggtgg

SEQ ID NO: 11541 - DNA, 20 bp, Artificial Sequence
  Description of Artificial Sequence: Synthetic oligonucleotide
  Target: AGXT; (+) strand; PAM type: NRG; PAM sequence: GAG
aagaaaacctggaggtggag

SEQ ID NO: 11542 - DNA, 20 bp, Artificial Sequence
  Description of Artificial Sequence: Synthetic oligonucleotide
  Target: AGXT; (+) strand; PAM type: NRG; PAM sequence: AGG
agaaaacctggaggtggagg

SEQ ID NO: 11543 - DNA, 20 bp, Artificial Sequence
  Description of Artificial Sequence: Synthetic oligonucleotide
  Target: AGXT; (+) strand; PAM type: NRG; PAM sequence: GGG
gaaaacctggaggtggagga

SEQ ID NO: 11544 - DNA, 20 bp, Artificial Sequence
  Description of Artificial Sequence: Synthetic oligonucleotide
  Target: AGXT; (+) strand; PAM type: NRG; PAM sequence: GAG
acctggaggtggaggagggt

SEQ ID NO: 11545 - DNA, 20 bp, Artificial Sequence
  Description of Artificial Sequence: Synthetic oligonucleotide
  Target: AGXT; (+) strand; PAM type: NRG; PAM sequence: GAG
ctggaggtggaggagggtga

SEQ ID NO: 11546 - DNA, 20 bp, Artificial Sequence
  Description of Artificial Sequence: Synthetic oligonucleotide
  Target: AGXT; (+) strand; PAM type: NRG; PAM sequence: TGG
agggtgagagtttgtgaaca

SEQ ID NO: 11547 - DNA, 20 bp, Artificial Sequence
  Description of Artificial Sequence: Synthetic oligonucleotide
  Target: AGXT; (+) strand; PAM type: NRG; PAM sequence: GAG
ggtgagagtttgtgaacatg

SEQ ID NO: 11548 - DNA, 20 bp, Artificial Sequence
  Description of Artificial Sequence: Synthetic oligonucleotide
  Target: AGXT; (+) strand; PAM type: NRG; PAM sequence: AGG
gtgagagtttgtgaacatgg

SEQ ID NO: 11549 - DNA, 20 bp, Artificial Sequence
  Description of Artificial Sequence: Synthetic oligonucleotide
  Target: AGXT; (+) strand; PAM type: NRG; PAM sequence: CGG
agagtttgtgaacatggagg

SEQ ID NO: 11550 - DNA, 20 bp, Artificial Sequence
  Description of Artificial Sequence: Synthetic oligonucleotide
  Target: AGXT; (+) strand; PAM type: NRG; PAM sequence: GAG
agtttgtgaacatggaggcg

SEQ ID NO: 11551 - DNA, 20 bp, Artificial Sequence
  Description of Artificial Sequence: Synthetic oligonucleotide
  Target: AGXT; (+) strand; PAM type: NRG; PAM sequence: AGG
gtttgtgaacatggaggcgg

SEQ ID NO: 11552 - DNA, 20 bp, Artificial Sequence
  Description of Artificial Sequence: Synthetic oligonucleotide
  Target: AGXT; (+) strand; PAM type: NRG; PAM sequence: GAG
ttgtgaacatggaggcggag

SEQ ID NO: 11553 - DNA, 20 bp, Artificial Sequence
  Description of Artificial Sequence: Synthetic oligonucleotide
  Target: AGXT; (+) strand; PAM type: NRG; PAM sequence: AGG
tgtgaacatggaggcggagg

SEQ ID NO: 11554 - DNA, 20 bp, Artificial Sequence
  Description of Artificial Sequence: Synthetic oligonucleotide
  Target: AGXT; (+) strand; PAM type: NRG; PAM sequence: GGG
gtgaacatggaggcggagga

SEQ ID NO: 11555 - DNA, 20 bp, Artificial Sequence
  Description of Artificial Sequence: Synthetic oligonucleotide
  Target: AGXT; (+) strand; PAM type: NRG; PAM sequence: GAG
acatggaggcggaggagggt

SEQ ID NO: 11556 - DNA, 20 bp, Artificial Sequence
  Description of Artificial Sequence: Synthetic oligonucleotide
  Target: AGXT; (+) strand; PAM type: NRG; PAM sequence: GAG
atggaggcggaggagggtga

SEQ ID NO: 11557 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11558 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11559 - DNA, 20 bp, Artificial Sequence
  Description of Artificial Sequence: Synthetic oligonucleotide
  Target: AGXT; (+) strand; PAM type: NRG; PAM sequence: CGG
agagttcgtgaacatgcagg

SEQ ID NO: 11560 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggcg

SEQ ID NO: 11561 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggcgg

SEQ ID NO: 11562 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgcaggcggag

SEQ ID NO: 11563 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgcaggcggagg

SEQ ID NO: 11564 - DNA, 20 bp, Artificial Sequence
  Description of Artificial Sequence: Synthetic oligonucleotide
  Target: AGXT; (+) strand; PAM type: NRG; PAM sequence: GGG
gtgaacatgcaggcggagga

SEQ ID NO: 11565 - DNA, 20 bp, Artificial Sequence
  Description of Artificial Sequence: Synthetic oligonucleotide
  Target: AGXT; (+) strand; PAM type: NRG; PAM sequence: GAG
acatgcaggcggaggagggt

SEQ ID NO: 11566 - DNA, 20 bp, Artificial Sequence
  Description of Artificial Sequence: Synthetic oligonucleotide
  Target: AGXT; (+) strand; PAM type: NRG; PAM sequence: GAG
atgcaggcggaggagggtga

SEQ ID NO: 11567 - DNA, 20 bp, Artificial Sequence
  Description of Artificial Sequence: Synthetic oligonucleotide
  Target: AGXT; (+) strand; PAM type: NRG; PAM sequence: TAG
ggtgagagttcgtgaacatg

SEQ ID NO: 11568 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgt

SEQ ID NO: 11569 - DNA, 20 bp, Artificial Sequence
  Description of Artificial Sequence: Synthetic oligonucleotide
  Target: AGXT; (+) strand; PAM type: NRG; PAM sequence: TGG
agagttcgtgaacatgtagg

SEQ ID NO: 11570 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgtaggtg

SEQ ID NO: 11571 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgtaggtgg

SEQ ID NO: 11572 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgtaggtggag

SEQ ID NO: 11573 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgtaggtggagg

SEQ ID NO: 11574 - DNA, 20 bp, Artificial Sequence
  Description of Artificial Sequence: Synthetic oligonucleotide
  Target: AGXT; (+) strand; PAM type: NRG; PAM sequence: AAG
acatgtaggtggaggaggat

SEQ ID NO: 11575 - DNA, 20 bp, Artificial Sequence
  Description of Artificial Sequence: Synthetic oligonucleotide
  Target: AGXT; (+) strand; PAM type: NRG; PAM sequence: GAG
atgtaggtggaggaggataa

SEQ ID NO: 11576 - DNA, 20 bp, Artificial Sequence
  Description of Artificial Sequence: Synthetic oligonucleotide
  Target: AGXT; (+) strand; PAM type: NRG; PAM sequence: CAG
gataagagttcgtgaacatg

SEQ ID NO: 11577 - DNA, 20 bp, Artificial Sequence
  Description of Artificial Sequence: Synthetic oligonucleotide
  Target: AGXT; (+) strand; PAM type: NRG; PAM sequence: AGG
ataagagttcgtgaacatgc

SEQ ID NO: 11578 - DNA, 20 bp, Artificial Sequence
  Description of Artificial Sequence: Synthetic oligonucleotide
  Target: AGXT; (+) strand; PAM type: NRG; PAM sequence: GAG
aagagttcgtgaacatgcag

SEQ ID NO: 11579 - DNA, 20 bp, Artificial Sequence
  Description of Artificial Sequence: Synthetic oligonucleotide
  Target: AGXT; (+) strand; PAM type: NRG; PAM sequence: AGG
agagttcgtgaacatgcagg

SEQ ID NO: 11580 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggag

SEQ ID NO: 11581 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggagg

SEQ ID NO: 11582 - DNA, 20 bp, Artificial Sequence
  Description of Artificial Sequence: Synthetic oligonucleotide
  Target: AGXT; (+) strand; PAM type: NRG; PAM sequence: GGG
ttcgtgaacatgcaggagga

SEQ ID NO: 11583 - DNA, 20 bp, Artificial Sequence
  Description of Artificial Sequence: Synthetic oligonucleotide
  Target: AGXT; (+) strand; PAM type: NRG; PAM sequence: GAG
tgaacatgcaggaggagggt

SEQ ID NO: 11584 - DNA, 20 bp, Artificial Sequence
  Description of Artificial Sequence: Synthetic oligonucleotide
  Target: AGXT; (+) strand; PAM type: NRG; PAM sequence: GAG
aacatgcaggaggagggtga

SEQ ID NO: 11585 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11586 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11587 - DNA, 20 bp, Artificial Sequence
  Description of Artificial Sequence: Synthetic oligonucleotide
  Target: AGXT; (+) strand; PAM type: NRG; PAM sequence: GAG
gagagttcgtgaacatgcag

SEQ ID NO: 11588 - DNA, 20 bp, Artificial Sequence
  Description of Artificial Sequence: Synthetic oligonucleotide
  Target: AGXT; (+) strand; PAM type: NRG; PAM sequence: AGG
agagttcgtgaacatgcagg

SEQ ID NO: 11589 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggag

SEQ ID NO: 11590 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggagg

SEQ ID NO: 11591 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgcaggaggag

SEQ ID NO: 11592 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgcaggaggagg

SEQ ID NO: 11593 - DNA, 20 bp, Artificial Sequence
  Description of Artificial Sequence: Synthetic oligonucleotide
  Target: AGXT; (+) strand; PAM type: NRG; PAM sequence: GGG
gtgaacatgcaggaggagga

SEQ ID NO: 11594 - DNA, 20 bp, Artificial Sequence
  Description of Artificial Sequence: Synthetic oligonucleotide
  Target: AGXT; (+) strand; PAM type: NRG; PAM sequence: GAG
acatgcaggaggaggagggt

SEQ ID NO: 11595 - DNA, 20 bp, Artificial Sequence
  Description of Artificial Sequence: Synthetic oligonucleotide
  Target: AGXT; (+) strand; PAM type: NRG; PAM sequence: GAG
atgcaggaggaggagggtga

SEQ ID NO: 11596 - DNA, 20 bp, Artificial Sequence
  Description of Artificial Sequence: Synthetic oligonucleotide
  Target: AGXT; (+) strand; PAM type: NRG; PAM sequence: TGG
agggtgagagttcgtgaaca

SEQ ID NO: 11597 - DNA, 20 bp, Artificial Sequence
  Description of Artificial Sequence: Synthetic oligonucleotide
  Target: AGXT; (+) strand; PAM type: NRG; PAM sequence: GAG
ggtgagagttcgtgaacatg

SEQ ID NO: 11598 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgg

SEQ ID NO: 11599 - DNA, 20 bp, Artificial Sequence
  Description of Artificial Sequence: Synthetic oligonucleotide
  Target: AGXT; (+) strand; PAM type: NRG; PAM sequence: GAG
gagagttcgtgaacatggag

SEQ ID NO: 11600 - DNA, 20 bp, Artificial Sequence
  Description of Artificial Sequence: Synthetic oligonucleotide
  Target: AGXT; (+) strand; PAM type: NRG; PAM sequence: AGG
agagttcgtgaacatggagg

SEQ ID NO: 11601 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatggaggag

SEQ ID NO: 11602 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatggaggagg

SEQ ID NO: 11603 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatggaggaggag

SEQ ID NO: 11604 - DNA, 20 bp, Artificial Sequence
  Description of Artificial Sequence: Synthetic oligonucleotide
  Target: AGXT; (+) strand; PAM type: NRG; PAM sequence: AGG
cgtgaacatggaggaggagg

SEQ ID NO: 11605 - DNA, 20 bp, Artificial Sequence
  Description of Artificial Sequence: Synthetic oligonucleotide
  Target: AGXT; (+) strand; PAM type: NRG; PAM sequence: GGG
gtgaacatggaggaggagga

SEQ ID NO: 11606 - DNA, 20 bp, Artificial Sequence
  Description of Artificial Sequence: Synthetic oligonucleotide
  Target: AGXT; (+) strand; PAM type: NRG; PAM sequence: GAG
acatggaggaggaggagggt

SEQ ID NO: 11607 - DNA, 20 bp, Artificial Sequence
  Description of Artificial Sequence: Synthetic oligonucleotide
  Target: AGXT; (+) strand; PAM type: NRG; PAM sequence: GAG
atggaggaggaggagggtga

SEQ ID NO: 11608 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11609 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11610 - DNA, 20 bp, Artificial Sequence
  Description of Artificial Sequence: Synthetic oligonucleotide
  Target: AGXT; (+) strand; PAM type: NRG; PAM sequence: CGG
agagttcgtgaacatgcagg

SEQ ID NO: 11611 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggcg

SEQ ID NO: 11612 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggcgg

SEQ ID NO: 11613 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgcaggcggag

SEQ ID NO: 11614 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgcaggcggagg

SEQ ID NO: 11615 - DNA, 20 bp, Artificial Sequence
  Description of Artificial Sequence: Synthetic oligonucleotide
  Target: AGXT; (+) strand; PAM type: NRG; PAM sequence: GGG
gtgaacatgcaggcggagga

SEQ ID NO: 11616 - DNA, 20 bp, Artificial Sequence
  Description of Artificial Sequence: Synthetic oligonucleotide
  Target: AGXT; (+) strand; PAM type: NRG; PAM sequence: GAG
acatgcaggcggaggagggt

SEQ ID NO: 11617 - DNA, 20 bp, Artificial Sequence
  Description of Artificial Sequence: Synthetic oligonucleotide
  Target: AGXT; (+) strand; PAM type: NRG; PAM sequence: GAG
atgcaggcggaggagggtga

SEQ ID NO: 11618 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11619 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11620 - DNA, 20 bp, Artificial Sequence
  Description of Artificial Sequence: Synthetic oligonucleotide
  Target: AGXT; (+) strand; PAM type: NRG; PAM sequence: TGG
agagttcgtgaacatgcagg

SEQ ID NO: 11621 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggtg

SEQ ID NO: 11622 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggtgg

SEQ ID NO: 11623 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgcaggtggag

SEQ ID NO: 11624 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgcaggtggagg

SEQ ID NO: 11625 - DNA, 20 bp, Artificial Sequence
  Description of Artificial Sequence: Synthetic oligonucleotide
  Target: AGXT; (+) strand; PAM type: NRG; PAM sequence: GGG
gtgaacatgcaggtggagga

SEQ ID NO: 11626 - DNA, 20 bp, Artificial Sequence
  Description of Artificial Sequence: Synthetic oligonucleotide
  Target: AGXT; (+) strand; PAM type: NRG; PAM sequence: GAG
acatgcaggtggaggagggt

SEQ ID NO: 11627 - DNA, 20 bp, Artificial Sequence
  Description of Artificial Sequence: Synthetic oligonucleotide
  Target: AGXT; (+) strand; PAM type: NRG; PAM sequence: GAG
atgcaggtggaggagggtga

SEQ ID NO: 11628 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11629 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11630 - DNA, 20 bp, Artificial Sequence
  Description of Artificial Sequence: Synthetic oligonucleotide
  Target: AGXT; (+) strand; PAM type: NRG; PAM sequence: GAG
gagagttcgtgaacatgcag

SEQ ID NO: 11631 - DNA, 20 bp, Artificial Sequence
  Description of Artificial Sequence: Synthetic oligonucleotide
  Target: AGXT; (+) strand; PAM type: NRG; PAM sequence: AGG
agagttcgtgaacatgcagg

SEQ ID NO: 11632 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggag

SEQ ID NO: 11633 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggagg

SEQ ID NO: 11634 - DNA, 20 bp, Artificial Sequence
  Description of Artificial Sequence: Synthetic oligonucleotide
  Target: AGXT; (+) strand; PAM type: NRG; PAM sequence: GGG
ttcgtgaacatgcaggagga

SEQ ID NO: 11635 - DNA, 20 bp, Artificial Sequence
  Description of Artificial Sequence: Synthetic oligonucleotide
  Target: AGXT; (+) strand; PAM type: NRG; PAM sequence: GAG
tgaacatgcaggaggagggt

SEQ ID NO: 11636 - DNA, 20 bp, Artificial Sequence
  Description of Artificial Sequence: Synthetic oligonucleotide
  Target: AGXT; (+) strand; PAM type: NRG; PAM sequence: GAG
aacatgcaggaggagggtga

SEQ ID NO: 11637 - DNA, 20 bp, Artificial Sequence
  Description of Artificial Sequence: Synthetic oligonucleotide
  Target: AGXT; (+) strand; PAM type: NRG; PAM sequence: CAG
ggtgagagttcgtgaacatg

SEQ ID NO: 11638 - DNA, 20 bp, Artificial Sequence
  Description of Artificial Sequence: Synthetic oligonucleotide
  Target: AGXT; (+) strand; PAM type: NRG; PAM sequence: AGG
gtgagagttcgtgaacatgc

SEQ ID NO: 11639 - DNA, 20 bp, Artificial Sequence
  Description of Artificial Sequence: Synthetic oligonucleotide
  Target: AGXT; (+) strand; PAM type: NRG; PAM sequence: GAG
gagagttcgtgaacatgcag

SEQ ID NO: 11640 - DNA, 20 bp, Artificial Sequence
  Description of Artificial Sequence: Synthetic oligonucleotide
  Target: AGXT; (+) strand; PAM type: NRG; PAM sequence: AGG
agagttcgtgaacatgcagg

SEQ ID NO: 11641 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatgcaggag

SEQ ID NO: 11642 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatgcaggagg

SEQ ID NO: 11643 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatgcaggaggag

SEQ ID NO: 11644 - DNA, 20 bp, Artificial Sequence
  Description of Artificial Sequence: Synthetic oligonucleotide
  Target: AGXT; (+) strand; PAM type: NRG; PAM sequence: AGG
cgtgaacatgcaggaggagg

SEQ ID NO: 11645 - DNA, 20 bp, Artificial Sequence
  Description of Artificial Sequence: Synthetic oligonucleotide
  Target: AGXT; (+) strand; PAM type: NRG; PAM sequence: GGG
gtgaacatgcaggaggagga

SEQ ID NO: 11646 - DNA, 20 bp, Artificial Sequence
  Description of Artificial Sequence: Synthetic oligonucleotide
  Target: AGXT; (+) strand; PAM type: NRG; PAM sequence: GAG
acatgcaggaggaggagggc

SEQ ID NO: 11647 - DNA, 20 bp, Artificial Sequence
  Description of Artificial Sequence: Synthetic oligonucleotide
  Target: AGXT; (+) strand; PAM type: NRG; PAM sequence: GAG
atgcaggaggaggagggcga

SEQ ID NO: 11648 - DNA, 20 bp, Artificial Sequence
  Description of Artificial Sequence: Synthetic oligonucleotide
  Target: AGXT; (+) strand; PAM type: NRG; PAM sequence: TGG
agggcgagagttcgtgaaca

SEQ ID NO: 11649 - DNA, 20 bp, Artificial Sequence
  Description of Artificial Sequence: Synthetic oligonucleotide
  Target: AGXT; (+) strand; PAM type: NRG; PAM sequence: GAG
ggcgagagttcgtgaacatg

SEQ ID NO: 11650 - DNA, 20 bp, Artificial Sequence
  Description of Artificial Sequence: Synthetic oligonucleotide
  Target: AGXT; (+) strand; PAM type: NRG; PAM sequence: AGG
gcgagagttcgtgaacatgg

SEQ ID NO: 11651 - DNA, 20 bp, Artificial Sequence
  Description of Artificial Sequence: Synthetic oligonucleotide
  Target: AGXT; (+) strand; PAM type: NRG; PAM sequence: CGG
agagttcgtgaacatggagg

SEQ ID NO: 11652 - DNA, 20 bp, Artificial Sequence
  Description of Artificial Sequence: Synthetic oligonucleotide
  Target: AGXT; (+) strand; PAM type: NRG; PAM sequence: GAG
agttcgtgaacatggaggcg

SEQ ID NO: 11653 - DNA, 20 bp, Artificial Sequence
  Description of Artificial Sequence: Synthetic oligonucleotide
  Target: AGXT; (+) strand; PAM type: NRG; PAM sequence: AGG
gttcgtgaacatggaggcgg

SEQ ID NO: 11654 - DNA, 20 bp, Artificial Sequence
  Description of Artificial Sequence: Synthetic oligonucleotide
  Target: AGXT; (+) strand; PAM type: NRG; PAM sequence: GAG
tcgtgaacatggaggcggag

SEQ ID NO: 11655 - DNA, 20 bp, Artificial Sequence
  Description of Artificial Sequence: Synthetic oligonucleotide
  Target: AGXT; (+) strand; PAM type: NRG; PAM sequence: AGG
cgtgaacatggaggcggagg

SEQ ID NO: 11656 - DNA, 20 bp, Artificial Sequence
  Description of Artificial Sequence: Synthetic oligonucleotide
  Target: AGXT; (+) strand; PAM type: NRG; PAM sequence: GGG
gtgaacatggaggcggagga

SEQ ID NO: 11657 - DNA, 20 bp, Artificial Sequence
  Description of Artificial Sequence: Synthetic oligonucleotide
  Target: AGXT; (+) strand; PAM type: NRG; PAM sequence: GAG
acatggaggcggaggagggt

SEQ ID NO: 11658 - DNA, 20 bp, Artificial Sequence
  Description of Artificial Sequence: Synthetic oligonucleotide
  Target: AGXT; (+) strand; PAM type: NRG; PAM sequence: GAG
atggaggcggaggagggtga

SEQ ID NO: 11659 - DNA, 20 bp, Artificial Sequence
  Description of Artificial Sequence: Synthetic oligonucleotide
  Target: AGXT; (+) strand; PAM type: NRG; PAM sequence: TGG
cggaggagggtgagagtttg

SEQ ID NO: 11660 - DNA, 20 bp, Artificial Sequence
  Description of Artificial Sequence: Synthetic oligonucleotide
  Target: AGXT; (+) strand; PAM type: NRG; PAM sequence: TGG
gagtttgtggcgctgctgct

SEQ ID NO: 11661 - DNA, 20 bp, Artificial Sequence
  Description of Artificial Sequence: Synthetic oligonucleotide
  Target: AGXT; (+) strand; PAM type: NRG; PAM sequence: GGG
agtttgtggcgctgctgctt

SEQ ID NO: 11662 - DNA, 20 bp, Artificial Sequence
  Description of Artificial Sequence: Synthetic oligonucleotide
  Target: AGXT; (+) strand; PAM type: NRG; PAM sequence: TGG
cgctgctgcttgggctgttc

SEQ ID NO: 11663 - DNA, 20 bp, Artificial Sequence
  Description of Artificial Sequence: Synthetic oligonucleotide
  Target: AGXT; (+) strand; PAM type: NRG; PAM sequence: GGG
gctgctgcttgggctgttct

SEQ ID NO: 11664 - DNA, 20 bp, Artificial Sequence
  Description of Artificial Sequence: Synthetic oligonucleotide
  Target: AGXT; (+) strand; PAM type: NRG; PAM sequence: TGG
ttctgggactctgtcccctc

SEQ ID NO: 11665 - DNA, 20 bp, Artificial Sequence
  Description of Artificial Sequence: Synthetic oligonucleotide
  Target: AGXT; (+) strand; PAM type: NRG; PAM sequence: TAG
ggactctgtcccctctggcc

SEQ ID NO: 11666 - DNA, 20 bp, Artificial Sequence
  Description of Artificial Sequence: Synthetic oligonucleotide
  Target: AGXT; (+) strand; PAM type: NRG; PAM sequence: TGG
gtcccctctggcctagattc

SEQ ID NO: 11667 - DNA, 20 bp, Artificial Sequence
  Description of Artificial Sequence: Synthetic oligonucleotide
  Target: AGXT; (+) strand; PAM type: NRG; PAM sequence: CAG
cctctggcctagattctggc

SEQ ID NO: 11668 - DNA, 20 bp, Artificial Sequence
  Description of Artificial Sequence: Synthetic oligonucleotide
  Target: AGXT; (+) strand; PAM type: NRG; PAM sequence: TGG
ctggcctagattctggccag

SEQ ID NO: 11669 - DNA, 20 bp, Artificial Sequence
  Description of Artificial Sequence: Synthetic oligonucleotide
  Target: AGXT; (+) strand; PAM type: NRG; PAM sequence: TGG
cctagattctggccagtggc

SEQ ID NO: 11670 - DNA, 20 bp, Artificial Sequence
  Description of Artificial Sequence: Synthetic oligonucleotide
  Target: AGXT; (+) strand; PAM type: NRG; PAM sequence: GGG
ctagattctggccagtggct

SEQ ID NO: 11671 - DNA, 20 bp, Artificial Sequence
  Description of Artificial Sequence: Synthetic oligonucleotide
  Target: AGXT; (+) strand; PAM type: NRG; PAM sequence: GAG
ttctggccagtggctgggcc

SEQ ID NO: 11672 - DNA, 20 bp, Artificial Sequence
  Description of Artificial Sequence: Synthetic oligonucleotide
  Target: AGXT; (+) strand; PAM type: NRG; PAM sequence: CAG
tggccagtggctgggccgag

SEQ ID NO: 11673 - DNA, 20 bp, Artificial Sequence
  Description of Artificial Sequence: Synthetic oligonucleotide
  Target: AGXT; (+) strand; PAM type: NRG; PAM sequence: TGG
tggctgggccgagcagctgt

SEQ ID NO: 11674 - DNA, 20 bp, Artificial Sequence
  Description of Artificial Sequence: Synthetic oligonucleotide
  Target: AGXT; (+) strand; PAM type: NRG; PAM sequence: CAG
ctgggccgagcagctgttgg

SEQ ID NO: 11675 - DNA, 20 bp, Artificial Sequence
  Description of Artificial Sequence: Synthetic oligonucleotide
  Target: AGXT; (+) strand; PAM type: NRG; PAM sequence: GAG
gggccgagcagctgttggca

SEQ ID NO: 11676 - DNA, 20 bp, Artificial Sequence
  Description of Artificial Sequence: Synthetic oligonucleotide
  Target: AGXT; (+) strand; PAM type: NRG; PAM sequence: AGG
ggccgagcagctgttggcag

SEQ ID NO: 11677 - DNA, 20 bp, Artificial Sequence
  Description of Artificial Sequence: Synthetic oligonucleotide
  Target: AGXT; (+) strand; PAM type: NRG; PAM sequence: TAG
cgagcagctgttggcagagg

SEQ ID NO: 11678 - DNA, 20 bp, Artificial Sequence
  Description of Artificial Sequence: Synthetic oligonucleotide
  Target: AGXT; (+) strand; PAM type: NRG; PAM sequence: AGG
gagcagctgttggcagaggt

SEQ ID NO: 11679 - DNA, 20 bp, Artificial Sequence
  Description of Artificial Sequence: Synthetic oligonucleotide
  Target: AGXT; (+) strand; PAM type: NRG; PAM sequence: CAG
gctgttggcagaggtaggcc

SEQ ID NO: 11680 - DNA, 20 bp, Artificial Sequence
  Description of Artificial Sequence: Synthetic oligonucleotide
  Target: AGXT; (+) strand; PAM type: NRG; PAM sequence: TGG
tggcagaggtaggcccagcc

SEQ ID NO: 11681 - DNA, 20 bp, Artificial Sequence
  Description of Artificial Sequence: Synthetic oligonucleotide
  Target: AGXT; (+) strand; PAM type: NRG; PAM sequence: TGG
ggcccagcctggtgccaccc

SEQ ID NO: 11682 - DNA, 20 bp, Artificial Sequence
  Description of Artificial Sequence: Synthetic oligonucleotide
  Target: AGXT; (+) strand; PAM type: NRG; PAM sequence: TGG
cctggtgccaccctggtccc

SEQ ID NO: 11683 - DNA, 20 bp, Artificial Sequence
  Description of Artificial Sequence: Synthetic oligonucleotide
  Target: AGXT; (+) strand; PAM type: NRG; PAM sequence: GGG
ctggtgccaccctggtccct

SEQ ID NO: 11684 - DNA, 20 bp, Artificial Sequence
  Description of Artificial Sequence: Synthetic oligonucleotide
  Target: AGXT; (+) strand; PAM type: NRG; PAM sequence: GGG
tggtgccaccctggtccctg

SEQ ID NO: 11685 - DNA, 20 bp, Artificial Sequence
  Description of Artificial Sequence: Synthetic oligonucleotide
  Target: AGXT; (+) strand; PAM type: NRG; PAM sequence: CAG
cctggtccctggggtccaca

SEQ ID NO: 11686 - DNA, 20 bp, Artificial Sequence
  Description of Artificial Sequence: Synthetic oligonucleotide
  Target: AGXT; (+) strand; PAM type: NRG; PAM sequence: AGG
ctggtccctggggtccacac

SEQ ID NO: 11687 - DNA, 20 bp, Artificial Sequence
  Description of Artificial Sequence: Synthetic oligonucleotide
  Target: AGXT; (+) strand; PAM type: NRG; PAM sequence: CAG
ctggggtccacacaggccct

SEQ ID NO: 11688 - DNA, 20 bp, Artificial Sequence
  Description of Artificial Sequence: Synthetic oligonucleotide
  Target: AGXT; (+) strand; PAM type: NRG; PAM sequence: AGG
tggggtccacacaggccctc

SEQ ID NO: 11689 - DNA, 20 bp, Artificial Sequence
  Description of Artificial Sequence: Synthetic oligonucleotide
  Target: AGXT; (+) strand; PAM type: NRG; PAM sequence: TGG
cctcaggcacccgctgtccc

SEQ ID NO: 11690 - DNA, 20 bp, Artificial Sequence
  Description of Artificial Sequence: Synthetic oligonucleotide
  Target: AGXT; (+) strand; PAM type: NRG; PAM sequence: GGG
ctcaggcacccgctgtccct

SEQ ID NO: 11691 - DNA, 20 bp, Artificial Sequence
  Description of Artificial Sequence: Synthetic oligonucleotide
  Target: AGXT; (+) strand; PAM type: NRG; PAM sequence: CAG
cccgctgtccctgggaacca

SEQ ID NO: 11692 - DNA, 20 bp, Artificial Sequence
  Description of Artificial Sequence: Synthetic oligonucleotide
  Target: AGXT; (+) strand; PAM type: NRG; PAM sequence: CGG
cctgggaaccacagactgcc

SEQ ID NO: 11693 - DNA, 20 bp, Artificial Sequence
  Description of Artificial Sequence: Synthetic oligonucleotide
  Target: AGXT; (+) strand; PAM type: NRG; PAM sequence: CAG
actgcccggctgaccctctt

SEQ ID NO: 11694 - DNA, 20 bp, Artificial Sequence
  Description of Artificial Sequence: Synthetic oligonucleotide
  Target: AGXT; (+) strand; PAM type: NRG; PAM sequence: CGG
accctcttcagcaccactgc

SEQ ID NO: 11695 - DNA, 20 bp, Artificial Sequence
  Description of Artificial Sequence: Synthetic oligonucleotide
  Target: AGXT; (+) strand; PAM type: NRG; PAM sequence: GGG
ccctcttcagcaccactgcc

SEQ ID NO: 11696 - DNA, 20 bp, Artificial Sequence
  Description of Artificial Sequence: Synthetic oligonucleotide
  Target: AGXT; (+) strand; PAM type: NRG; PAM sequence: CAG
agcaccactgccgggccctg

SEQ ID NO: 11697 - DNA, 20 bp, Artificial Sequence
  Description of Artificial Sequence: Synthetic oligonucleotide
  Target: AGXT; (+) strand; PAM type: NRG; PAM sequence: TGG
ccactgccgggccctgcagc

SEQ ID NO: 11698 - DNA, 20 bp, Artificial Sequence
  Description of Artificial Sequence: Synthetic oligonucleotide
  Target: AGXT; (+) strand; PAM type: NRG; PAM sequence: GGG
cactgccgggccctgcagct

SEQ ID NO: 11699 - DNA, 20 bp, Artificial Sequence
  Description of Artificial Sequence: Synthetic oligonucleotide
  Target: AGXT; (+) strand; PAM type: NRG; PAM sequence: CAG
gccctgcagctgggtctcac

SEQ ID NO: 11700 - DNA, 20 bp, Artificial Sequence
  Description of Artificial Sequence: Synthetic oligonucleotide
  Target: AGXT; (+) strand; PAM type: NRG; PAM sequence: AGG
ccctgcagctgggtctcacc

SEQ ID NO: 11701 - DNA, 20 bp, Artificial Sequence
  Description of Artificial Sequence: Synthetic oligonucleotide
  Target: AGXT; (+) strand; PAM type: NRG; PAM sequence: GGG
cctgcagctgggtctcacca

SEQ ID NO: 11702 - DNA, 20 bp, Artificial Sequence
  Description of Artificial Sequence: Synthetic oligonucleotide
  Target: AGXT; (+) strand; PAM type: NRG; PAM sequence: CAG
gtgatgctccctcactcccc

SEQ ID NO: 11703 - DNA, 20 bp, Artificial Sequence
  Description of Artificial Sequence: Synthetic oligonucleotide
  Target: AGXT; (+) strand; PAM type: NRG; PAM sequence: CAG
gctccctctgctccaatgtt

SEQ ID NO: 11704 - DNA, 20 bp, Artificial Sequence
  Description of Artificial Sequence: Synthetic oligonucleotide
  Target: AGXT; (+) strand; PAM type: NRG; PAM sequence: AGG
ctccctctgctccaatgttc

SEQ ID NO: 11705 - DNA, 20 bp, Artificial Sequence
  Description of Artificial Sequence: Synthetic oligonucleotide
  Target: AGXT; (+) strand; PAM type: NRG; PAM sequence: GGG
tccctctgctccaatgttca

SEQ ID NO: 11706 - DNA, 20 bp, Artificial Sequence
  Description of Artificial Sequence: Synthetic oligonucleotide
  Target: AGXT; (+) strand; PAM type: NRG; PAM sequence: GAG
ctgctccaatgttcagggct

SEQ ID NO: 11707 - DNA, 20 bp, Artificial Sequence
  Description of Artificial Sequence: Synthetic oligonucleotide
  Target: AGXT; (+) strand; PAM type: NRG; PAM sequence: AAG
tccaatgttcagggctgaga

SEQ ID NO: 11708 - DNA, 20 bp, Artificial Sequence
  Description of Artificial Sequence: Synthetic oligonucleotide
  Target: AGXT; (+) strand; PAM type: NRG; PAM sequence: AGG
ccaatgttcagggctgagaa

SEQ ID NO: 11709 - DNA, 20 bp, Artificial Sequence
  Description of Artificial Sequence: Synthetic oligonucleotide
  Target: AGXT; (+) strand; PAM type: NRG; PAM sequence: AAG
atgttcagggctgagaaagg

SEQ ID NO: 11710 - DNA, 20 bp, Artificial Sequence
  Description of Artificial Sequence: Synthetic oligonucleotide
  Target: AGXT; (+) strand; PAM type: NRG; PAM sequence: GAG
gttcagggctgagaaaggaa

SEQ ID NO: 11711 - DNA, 20 bp, Artificial Sequence
  Description of Artificial Sequence: Synthetic oligonucleotide
  Target: AGXT; (+) strand; PAM type: NRG; PAM sequence: CAG
ggctgagaaaggaagagcca

SEQ ID NO: 11712 - DNA, 20 bp, Artificial Sequence
  Description of Artificial Sequence: Synthetic oligonucleotide
  Target: AGXT; (+) strand; PAM type: NRG; PAM sequence: AGG
gctgagaaaggaagagccac

SEQ ID NO: 11713 - DNA, 20 bp, Artificial Sequence
  Description of Artificial Sequence: Synthetic oligonucleotide
  Target: AGXT; (+) strand; PAM type: NRG; PAM sequence: TGG
ggaagagccacaggtcctga

SEQ ID NO: 11714 - DNA, 20 bp, Artificial Sequence
  Description of Artificial Sequence: Synthetic oligonucleotide
  Target: AGXT; (+) strand; PAM type: NRG; PAM sequence: CAG
caggtcctgatggatcctga

SEQ ID NO: 11715 - DNA, 20 bp, Artificial Sequence
  Description of Artificial Sequence: Synthetic oligonucleotide
  Target: AGXT; (+) strand; PAM type: NRG; PAM sequence: AGG
aggtcctgatggatcctgac

SEQ ID NO: 11716 - DNA, 20 bp, Artificial Sequence
  Description of Artificial Sequence: Synthetic oligonucleotide
  Target: AGXT; (+) strand; PAM type: NRG; PAM sequence: CAG
tcctgatggatcctgacagg

SEQ ID NO: 11717 - DNA, 20 bp, Artificial Sequence
  Description of Artificial Sequence: Synthetic oligonucleotide
  Target: AGXT; (+) strand; PAM type: NRG; PAM sequence: AGG
cctgatggatcctgacaggc

SEQ ID NO: 11718 - DNA, 20 bp, Artificial Sequence
  Description of Artificial Sequence: Synthetic oligonucleotide
  Target: AGXT; (+) strand; PAM type: NRG; PAM sequence: GAG
tgatggatcctgacaggcag

SEQ ID NO: 11719 - DNA, 20 bp, Artificial Sequence
  Description of Artificial Sequence: Synthetic oligonucleotide
  Target: AGXT; (+) strand; PAM type: NRG; PAM sequence: AAG
tggatcctgacaggcaggag

SEQ ID NO: 11720 - DNA, 20 bp, Artificial Sequence
  Description of Artificial Sequence: Synthetic oligonucleotide
  Target: AGXT; (+) strand; PAM type: NRG; PAM sequence: AGG
ggatcctgacaggcaggaga

SEQ ID NO: 11721 - DNA, 20 bp, Artificial Sequence
  Description of Artificial Sequence: Synthetic oligonucleotide
  Target: AGXT; (+) strand; PAM type: NRG; PAM sequence: TGG
gacaggcaggagaaggcaac

SEQ ID NO: 11722 - DNA, 20 bp, Artificial Sequence
  Description of Artificial Sequence: Synthetic oligonucleotide
  Target: AGXT; (+) strand; PAM type: NRG; PAM sequence: TGG
gaaggcaactggccaactcc

SEQ ID NO: 11723 - DNA, 20 bp, Artificial Sequence
  Description of Artificial Sequence: Synthetic oligonucleotide
  Target: AGXT; (+) strand; PAM type: NRG; PAM sequence: GGG
aaggcaactggccaactcct

SEQ ID NO: 11724 - DNA, 20 bp, Artificial Sequence
  Description of Artificial Sequence: Synthetic oligonucleotide
  Target: AGXT; (+) strand; PAM type: NRG; PAM sequence: GGG
aggcaactggccaactcctg

SEQ ID NO: 11725 - DNA, 20 bp, Artificial Sequence
  Description of Artificial Sequence: Synthetic oligonucleotide
  Target: AGXT; (+) strand; PAM type: NRG; PAM sequence: TGG
caactggccaactcctgggg

SEQ ID NO: 11726 - DNA, 20 bp, Artificial Sequence
  Description of Artificial Sequence: Synthetic oligonucleotide
  Target: AGXT; (+) strand; PAM type: NRG; PAM sequence: GAG
actggccaactcctggggtg

SEQ ID NO: 11727 - DNA, 20 bp, Artificial Sequence
  Description of Artificial Sequence: Synthetic oligonucleotide
  Target: AGXT; (+) strand; PAM type: NRG; PAM sequence: AGG
ctggccaactcctggggtgg

SEQ ID NO: 11728 - DNA, 20 bp, Artificial Sequence
  Description of Artificial Sequence: Synthetic oligonucleotide
  Target: AGXT; (+) strand; PAM type: NRG; PAM sequence: TGG
gccaactcctggggtggagg

SEQ ID NO: 11729 - DNA, 20 bp, Artificial Sequence
  Description of Artificial Sequence: Synthetic oligonucleotide
  Target: AGXT; (+) strand; PAM type: NRG; PAM sequence: GGG
ccaactcctggggtggaggt

SEQ ID NO: 11730 - DNA, 20 bp, Artificial Sequence
  Description of Artificial Sequence: Synthetic oligonucleotide
  Target: AGXT; (+) strand; PAM type: NRG; PAM sequence: GAG
aactcctggggtggaggtgg

SEQ ID NO: 11731 - DNA, 20 bp, Artificial Sequence
  Description of Artificial Sequence: Synthetic oligonucleotide
  Target: AGXT; (+) strand; PAM type: NRG; PAM sequence: AGG
actcctggggtggaggtggg

SEQ ID NO: 11732 - DNA, 20 bp, Artificial Sequence
  Description of Artificial Sequence: Synthetic oligonucleotide
  Target: AGXT; (+) strand; PAM type: NRG; PAM sequence: CAG
aggtgccctgccttccttgc

SEQ ID NO: 11733 - DNA, 20 bp, Artificial Sequence
  Description of Artificial Sequence: Synthetic oligonucleotide
  Target: AGXT; (+) strand; PAM type: NRG; PAM sequence: GAG
cctgccttccttgccagcct

SEQ ID NO: 11734 - DNA, 20 bp, Artificial Sequence
  Description of Artificial Sequence: Synthetic oligonucleotide
  Target: AGXT; (+) strand; PAM type: NRG; PAM sequence: AGG
ctgccttccttgccagcctg

SEQ ID NO: 11735 - DNA, 20 bp, Artificial Sequence
  Description of Artificial Sequence: Synthetic oligonucleotide
  Target: AGXT; (+) strand; PAM type: NRG; PAM sequence: CAG
ttccttgccagcctgaggct

SEQ ID NO: 11736 - DNA, 20 bp, Artificial Sequence
  Description of Artificial Sequence: Synthetic oligonucleotide
  Target: AGXT; (+) strand; PAM type: NRG; PAM sequence: CAG
tgaggctcagaaaccccatc

SEQ ID NO: 11737 - DNA, 20 bp, Artificial Sequence
  Description of Artificial Sequence: Synthetic oligonucleotide
  Target: AGXT; (+) strand; PAM type: NRG; PAM sequence: TGG
ctcagaaaccccatccagcc

SEQ ID NO: 11738 - DNA, 20 bp, Artificial Sequence
  Description of Artificial Sequence: Synthetic oligonucleotide
  Target: AGXT; (+) strand; PAM type: NRG; PAM sequence: GGG
tcagaaaccccatccagcct

SEQ ID NO: 11739 - DNA, 20 bp, Artificial Sequence
  Description of Artificial Sequence: Synthetic oligonucleotide
  Target: AGXT; (+) strand; PAM type: NRG; PAM sequence: GGG
cagaaaccccatccagcctg

SEQ ID NO: 11740 - DNA, 20 bp, Artificial Sequence
  Description of Artificial Sequence: Synthetic oligonucleotide
  Target: AGXT; (+) strand; PAM type: NRG; PAM sequence: CAG
aaccccatccagcctggggc

SEQ ID NO: 11741 - DNA, 20 bp, Artificial Sequence
  Description of Artificial Sequence: Synthetic oligonucleotide
  Target: AGXT; (+) strand; PAM type: NRG; PAM sequence: AGG
accccatccagcctggggcc

SEQ ID NO: 11742 - DNA, 20 bp, Artificial Sequence
  Description of Artificial Sequence: Synthetic oligonucleotide
  Target: AGXT; (+) strand; PAM type: NRG; PAM sequence: CAG
cagcctggggccaggccctc

SEQ ID NO: 11743 - DNA, 20 bp, Artificial Sequence
  Description of Artificial Sequence: Synthetic oligonucleotide
  Target: AGXT; (+) strand; PAM type: NRG; PAM sequence: TGG
cctggggccaggccctccag

SEQ ID NO: 11744 - DNA, 20 bp, Artificial Sequence
  Description of Artificial Sequence: Synthetic oligonucleotide
  Target: AGXT; (+) strand; PAM type: NRG; PAM sequence: CAG
cattctgtcccccacctctc

SEQ ID NO: 11745 - DNA, 20 bp, Artificial Sequence
  Description of Artificial Sequence: Synthetic oligonucleotide
  Target: AGXT; (+) strand; PAM type: NRG; PAM sequence: AGG
attctgtcccccacctctcc

SEQ ID NO: 11746 - DNA, 20 bp, Artificial Sequence
  Description of Artificial Sequence: Synthetic oligonucleotide
  Target: AGXT; (+) strand; PAM type: NRG; PAM sequence: AAG
tcccccacctctccaggtac

SEQ ID NO: 11747 - DNA, 20 bp, Artificial Sequence
  Description of Artificial Sequence: Synthetic oligonucleotide
  Target: AGXT; (+) strand; PAM type: NRG; PAM sequence: TGG
caggtacaagtgcctgctcc

SEQ ID NO: 11748 - DNA, 20 bp, Artificial Sequence
  Description of Artificial Sequence: Synthetic oligonucleotide
  Target: AGXT; (+) strand; PAM type: NRG; PAM sequence: TGG
gtacaagtgcctgctcctgg

SEQ ID NO: 11749 - DNA, 20 bp, Artificial Sequence
  Description of Artificial Sequence: Synthetic oligonucleotide
  Target: AGXT; (+) strand; PAM type: NRG; PAM sequence: CGG
gtgcctgctcctggtggatt

SEQ ID NO: 11750 - DNA, 20 bp, Artificial Sequence
  Description of Artificial Sequence: Synthetic oligonucleotide
  Target: AGXT; (+) strand; PAM type: NRG; PAM sequence: TGG
cctgctcctggtggattcgg

SEQ ID NO: 11751 - DNA, 20 bp, Artificial Sequence
  Description of Artificial Sequence: Synthetic oligonucleotide
  Target: AGXT; (+) strand; PAM type: NRG; PAM sequence: TGG
ggtggattcggtggcatccc

SEQ ID NO: 11752 - DNA, 20 bp, Artificial Sequence
  Description of Artificial Sequence: Synthetic oligonucleotide
  Target: AGXT; (+) strand; PAM type: NRG; PAM sequence: GGG
gtggattcggtggcatccct

SEQ ID NO: 11753 - DNA, 20 bp, Artificial Sequence
  Description of Artificial Sequence: Synthetic oligonucleotide
  Target: AGXT; (+) strand; PAM type: NRG; PAM sequence: CGG
gattcggtggcatccctggg

SEQ ID NO: 11754 - DNA, 20 bp, Artificial Sequence
  Description of Artificial Sequence: Synthetic oligonucleotide
  Target: AGXT; (+) strand; PAM type: NRG; PAM sequence: GGG
attcggtggcatccctgggc

SEQ ID NO: 11755 - DNA, 20 bp, Artificial Sequence
  Description of Artificial Sequence: Synthetic oligonucleotide
  Target: AGXT; (+) strand; PAM type: NRG; PAM sequence: TGG
gggcgggacccccctttaca

SEQ ID NO: 11756 - DNA, 20 bp, Artificial Sequence
  Description of Artificial Sequence: Synthetic oligonucleotide
  Target: AGXT; (+) strand; PAM type: NRG; PAM sequence: CGG
ggacccccctttacatggac

SEQ ID NO: 11757 - DNA, 20 bp, Artificial Sequence
  Description of Artificial Sequence: Synthetic oligonucleotide
  Target: AGXT; (+) strand; PAM type: NRG; PAM sequence: AAG
ccccctttacatggaccggc

SEQ ID NO: 11758 - DNA, 20 bp, Artificial Sequence
  Description of Artificial Sequence: Synthetic oligonucleotide
  Target: AGXT; (+) strand; PAM type: NRG; PAM sequence: AGG
cccctttacatggaccggca

SEQ ID NO: 11759 - DNA, 20 bp, Artificial Sequence
  Description of Artificial Sequence: Synthetic oligonucleotide
  Target: AGXT; (+) strand; PAM type: NRG; PAM sequence: AAG
tttacatggaccggcaaggt

SEQ ID NO: 11760 - DNA, 20 bp, Artificial Sequence
  Description of Artificial Sequence: Synthetic oligonucleotide
  Target: AGXT; (+) strand; PAM type: NRG; PAM sequence: AGG
ttacatggaccggcaaggta

SEQ ID NO: 11761 - DNA, 20 bp, Artificial Sequence
  Description of Artificial Sequence: Synthetic oligonucleotide
  Target: AGXT; (+) strand; PAM type: NRG; PAM sequence: GGG
tacatggaccggcaaggtaa

SEQ ID NO: 11762 - DNA, 20 bp, Artificial Sequence
  Description of Artificial Sequence: Synthetic oligonucleotide
  Target: AGXT; (+) strand; PAM type: NRG; PAM sequence: TGG
atggaccggcaaggtaaggg

SEQ ID NO: 11763 - DNA, 20 bp, Artificial Sequence
  Description of Artificial Sequence: Synthetic oligonucleotide
  Target: AGXT; (+) strand; PAM type: NRG; PAM sequence: GGG
tggaccggcaaggtaagggt

SEQ ID NO: 11764 - DNA, 20 bp, Artificial Sequence
  Description of Artificial Sequence: Synthetic oligonucleotide
  Target: AGXT; (+) strand; PAM type: NRG; PAM sequence: GAG
gcaaggtaagggtgggctct

SEQ ID NO: 11765 - DNA, 20 bp, Artificial Sequence
  Description of Artificial Sequence: Synthetic oligonucleotide
  Target: AGXT; (+) strand; PAM type: NRG; PAM sequence: GAG
aaggtaagggtgggctctga

SEQ ID NO: 11766 - DNA, 20 bp, Artificial Sequence
  Description of Artificial Sequence: Synthetic oligonucleotide
  Target: AGXT; (+) strand; PAM type: NRG; PAM sequence: CAG
tgggctctgagagccctacc

SEQ ID NO: 11767 - DNA, 20 bp, Artificial Sequence
  Description of Artificial Sequence: Synthetic oligonucleotide
  Target: AGXT; (+) strand; PAM type: NRG; PAM sequence: AAG
ctgagagccctacccagccc

SEQ ID NO: 11768 - DNA, 20 bp, Artificial Sequence
  Description of Artificial Sequence: Synthetic oligonucleotide
  Target: AGXT; (+) strand; PAM type: NRG; PAM sequence: CAG
agagccctacccagcccaag

SEQ ID NO: 11769 - DNA, 20 bp, Artificial Sequence
  Description of Artificial Sequence: Synthetic oligonucleotide
  Target: AGXT; (+) strand; PAM type: NRG; PAM sequence: TGG
ctacccagcccaagcagcct

SEQ ID NO: 11770 - DNA, 20 bp, Artificial Sequence
  Description of Artificial Sequence: Synthetic oligonucleotide
  Target: AGXT; (+) strand; PAM type: NRG; PAM sequence: GGG
tacccagcccaagcagcctt

SEQ ID NO: 11771 - DNA, 20 bp, Artificial Sequence
  Description of Artificial Sequence: Synthetic oligonucleotide
  Target: AGXT; (+) strand; PAM type: NRG; PAM sequence: GGG
acccagcccaagcagccttg

SEQ ID NO: 11772 - DNA, 20 bp, Artificial Sequence
  Description of Artificial Sequence: Synthetic oligonucleotide
  Target: AGXT; (+) strand; PAM type: NRG; PAM sequence: CAG
cagccttggggctccgcgtg

SEQ ID NO: 11773 - DNA, 20 bp, Artificial Sequence
  Description of Artificial Sequence: Synthetic oligonucleotide
  Target: AGXT; (+) strand; PAM type: NRG; PAM sequence: AGG
agccttggggctccgcgtgc

SEQ ID NO: 11774 - DNA, 20 bp, Artificial Sequence
  Description of Artificial Sequence: Synthetic oligonucleotide
  Target: AGXT; (+) strand; PAM type: NRG; PAM sequence: AAG
cttggggctccgcgtgcagg

SEQ ID NO: 11775 - DNA, 20 bp, Artificial Sequence
  Description of Artificial Sequence: Synthetic oligonucleotide
  Target: AGXT; (+) strand; PAM type: NRG; PAM sequence: TGG
ccgcgtgcaggaagccctgc

SEQ ID NO: 11776 - DNA, 20 bp, Artificial Sequence
  Description of Artificial Sequence: Synthetic oligonucleotide
  Target: AGXT; (+) strand; PAM type: NRG; PAM sequence: AAG
cgtgcaggaagccctgctgg

SEQ ID NO: 11777 - DNA, 20 bp, Artificial Sequence
  Description of Artificial Sequence: Synthetic oligonucleotide
  Target: AGXT; (+) strand; PAM type: NRG; PAM sequence: CAG
ccctgctggaagcgtgcgtc

SEQ ID NO: 11778 - DNA, 20 bp, Artificial Sequence
  Description of Artificial Sequence: Synthetic oligonucleotide
  Target: AGXT; (+) strand; PAM type: NRG; PAM sequence: CAG
tgctggaagcgtgcgtccag

SEQ ID NO: 11779 - DNA, 20 bp, Artificial Sequence
  Description of Artificial Sequence: Synthetic oligonucleotide
  Target: AGXT; (+) strand; PAM type: NRG; PAM sequence: CGG
gcgtccagcagccgatgctg

SEQ ID NO: 11780 - DNA, 20 bp, Artificial Sequence
  Description of Artificial Sequence: Synthetic oligonucleotide
  Target: AGXT; (+) strand; PAM type: NRG; PAM sequence: CGG
agcagccgatgctgcggatt

SEQ ID NO: 11781 - DNA, 20 bp, Artificial Sequence
  Description of Artificial Sequence: Synthetic oligonucleotide
  Target: AGXT; (+) strand; PAM type: NRG; PAM sequence: CAG
ggattcggccccatctccac

SEQ ID NO: 11782 - DNA, 20 bp, Artificial Sequence
  Description of Artificial Sequence: Synthetic oligonucleotide
  Target: AGXT; (+) strand; PAM type: NRG; PAM sequence: AGG
gattcggccccatctccacc

SEQ ID NO: 11783 - DNA, 20 bp, Artificial Sequence
  Description of Artificial Sequence: Synthetic oligonucleotide
  Target: AGXT; (+) strand; PAM type: NRG; PAM sequence: CAG
ggccccatctccaccaggcc

SEQ ID NO: 11784 - DNA, 20 bp, Artificial Sequence
  Description of Artificial Sequence: Synthetic oligonucleotide
  Target: AGXT; (+) strand; PAM type: NRG; PAM sequence: AGG
gccccatctccaccaggccc

SEQ ID NO: 11785 - DNA, 20 bp, Artificial Sequence
  Description of Artificial Sequence: Synthetic oligonucleotide
  Target: AGXT; (+) strand; PAM type: NRG; PAM sequence: GGG
ccccatctccaccaggccca

SEQ ID NO: 11786 - DNA, 20 bp, Artificial Sequence
  Description of Artificial Sequence: Synthetic oligonucleotide
  Target: AGXT; (+) strand; PAM type: NRG; PAM sequence: CGG
gaaacactcactccttactg

SEQ ID NO: 11787 - DNA, 20 bp, Artificial Sequence
  Description of Artificial Sequence: Synthetic oligonucleotide
  Target: AGXT; (+) strand; PAM type: NRG; PAM sequence: AAG
cactcactccttactgcggc

SEQ ID NO: 11788 - DNA, 20 bp, Artificial Sequence
  Description of Artificial Sequence: Synthetic oligonucleotide
  Target: AGXT; (+) strand; PAM type: NRG; PAM sequence: GAG
ctcactccttactgcggcaa

SEQ ID NO: 11789 - DNA, 20 bp, Artificial Sequence
  Description of Artificial Sequence: Synthetic oligonucleotide
  Target: AGXT; (+) strand; PAM type: NRG; PAM sequence: CGG
actccttactgcggcaagag

SEQ ID NO: 11790 - DNA, 20 bp, Artificial Sequence
  Description of Artificial Sequence: Synthetic oligonucleotide
  Target: AGXT; (+) strand; PAM type: NRG; PAM sequence: CAG
gagcggctccatgaactacc

SEQ ID NO: 11791 - DNA, 20 bp, Artificial Sequence
  Description of Artificial Sequence: Synthetic oligonucleotide
  Target: AGXT; (+) strand; PAM type: NRG; PAM sequence: CAG
ccatgaactacccagcaccc

SEQ ID NO: 11792 - DNA, 20 bp, Artificial Sequence
  Description of Artificial Sequence: Synthetic oligonucleotide
  Target: AGXT; (+) strand; PAM type: NRG; PAM sequence: GAG
agcaccccagtgtttccact

SEQ ID NO: 11793 - DNA, 20 bp, Artificial Sequence
  Description of Artificial Sequence: Synthetic oligonucleotide
  Target: AGXT; (+) strand; PAM type: NRG; PAM sequence: CAG
cagtgtttccactgagcttt

SEQ ID NO: 11794 - DNA, 20 bp, Artificial Sequence
  Description of Artificial Sequence: Synthetic oligonucleotide
  Target: AGXT; (+) strand; PAM type: NRG; PAM sequence: CAG
ttccactgagctttcagatc

SEQ ID NO: 11795 - DNA, 20 bp, Artificial Sequence
  Description of Artificial Sequence: Synthetic oligonucleotide
  Target: AGXT; (+) strand; PAM type: NRG; PAM sequence: AGG
tccactgagctttcagatcc

SEQ ID NO: 11796 - DNA, 20 bp, Artificial Sequence
  Description of Artificial Sequence: Synthetic oligonucleotide
  Target: AGXT; (+) strand; PAM type: NRG; PAM sequence: TGG
tgagctttcagatccaggcg

SEQ ID NO: 11797 - DNA, 20 bp, Artificial Sequence
  Description of Artificial Sequence: Synthetic oligonucleotide
  Target: AGXT; (+) strand; PAM type: NRG; PAM sequence: GGG
gagctttcagatccaggcgt

SEQ ID NO: 11798 - DNA, 20 bp, Artificial Sequence
  Description of Artificial Sequence: Synthetic oligonucleotide
  Target: AGXT; (+) strand; PAM type: NRG; PAM sequence: GGG
agctttcagatccaggcgtg

SEQ ID NO: 11799 - DNA, 20 bp, Artificial Sequence
  Description of Artificial Sequence: Synthetic oligonucleotide
  Target: AGXT; (+) strand; PAM type: NRG; PAM sequence: TGG
tcagatccaggcgtggggac

SEQ ID NO: 11800 - DNA, 20 bp, Artificial Sequence
  Description of Artificial Sequence: Synthetic oligonucleotide
  Target: AGXT; (+) strand; PAM type: NRG; PAM sequence: CAG
gatccaggcgtggggactgg

SEQ ID NO: 11801 - DNA, 20 bp, Artificial Sequence
  Description of Artificial Sequence: Synthetic oligonucleotide
  Target: AGXT; (+) strand; PAM type: NRG; PAM sequence: AGG
atccaggcgtggggactggc

SEQ ID NO: 11802 - DNA, 20 bp, Artificial Sequence
  Description of Artificial Sequence: Synthetic oligonucleotide
  Target: AGXT; (+) strand; PAM type: NRG; PAM sequence: GAG
ccaggcgtggggactggcag

SEQ ID NO: 11803 - DNA, 20 bp, Artificial Sequence
  Description of Artificial Sequence: Synthetic oligonucleotide
  Target: AGXT; (+) strand; PAM type: NRG; PAM sequence: AGG
caggcgtggggactggcagg

SEQ ID NO: 11804 - DNA, 20 bp, Artificial Sequence
  Description of Artificial Sequence: Synthetic oligonucleotide
  Target: AGXT; (+) strand; PAM type: NRG; PAM sequence: GGG
aggcgtggggactggcagga

SEQ ID NO: 11805 - DNA, 20 bp, Artificial Sequence
  Description of Artificial Sequence: Synthetic oligonucleotide
  Target: AGXT; (+) strand; PAM type: NRG; PAM sequence: CAG
gtggggactggcaggaggga

SEQ ID NO: 11806 - DNA, 20 bp, Artificial Sequence
  Description of Artificial Sequence: Synthetic oligonucleotide
  Target: AGXT; (+) strand; PAM type: NRG; PAM sequence: TGG
ctggcaggagggacagcttc

SEQ ID NO: 11807 - DNA, 20 bp, Artificial Sequence
  Description of Artificial Sequence: Synthetic oligonucleotide
  Target: AGXT; (+) strand; PAM type: NRG; PAM sequence: TGG
gcaggagggacagcttctgg

SEQ ID NO: 11808 - DNA, 20 bp, Artificial Sequence
  Description of Artificial Sequence: Synthetic oligonucleotide
  Target: AGXT; (+) strand; PAM type: NRG; PAM sequence: GGG
caggagggacagcttctggt

SEQ ID NO: 11809 - DNA, 20 bp, Artificial Sequence
  Description of Artificial Sequence: Synthetic oligonucleotide
  Target: AGXT; (+) strand; PAM type: NRG; PAM sequence: GGG
aggagggacagcttctggtg

SEQ ID NO: 11810 - DNA, 20 bp, Artificial Sequence
  Description of Artificial Sequence: Synthetic oligonucleotide
  Target: AGXT; (+) strand; PAM type: NRG; PAM sequence: GGG
ggagggacagcttctggtgg

SEQ ID NO: 11811 - DNA, 20 bp, Artificial Sequence
  Description of Artificial Sequence: Synthetic oligonucleotide
  Target: AGXT; (+) strand; PAM type: NRG; PAM sequence: GAG
gcttctggtgggggacattt

SEQ ID NO: 11812 - DNA, 20 bp, Artificial Sequence
  Description of Artificial Sequence: Synthetic oligonucleotide
  Target: AGXT; (+) strand; PAM type: NRG; PAM sequence: CAG
gggggacatttgagatgccc

SEQ ID NO: 11813 - DNA, 20 bp, Artificial Sequence
  Description of Artificial Sequence: Synthetic oligonucleotide
  Target: AGXT; (+) strand; PAM type: NRG; PAM sequence: GAG
gggacatttgagatgcccca

SEQ ID NO: 11814 - DNA, 20 bp, Artificial Sequence
  Description of Artificial Sequence: Synthetic oligonucleotide
  Target: AGXT; (+) strand; PAM type: NRG; PAM sequence: TAG
tttgagatgccccagagctg

SEQ ID NO: 11815 - DNA, 20 bp, Artificial Sequence
  Description of Artificial Sequence: Synthetic oligonucleotide
  Target: AGXT; (+) strand; PAM type: NRG; PAM sequence: CAG
gagatgccccagagctgtag

SEQ ID NO: 11816 - DNA, 20 bp, Artificial Sequence
  Description of Artificial Sequence: Synthetic oligonucleotide
  Target: AGXT; (+) strand; PAM type: NRG; PAM sequence: AAG
atgccccagagctgtagcag

SEQ ID NO: 11817 - DNA, 20 bp, Artificial Sequence
  Description of Artificial Sequence: Synthetic oligonucleotide
  Target: AGXT; (+) strand; PAM type: NRG; PAM sequence: CAG
ccccagagctgtagcagaag

SEQ ID NO: 11818 - DNA, 20 bp, Artificial Sequence
  Description of Artificial Sequence: Synthetic oligonucleotide
  Target: AGXT; (+) strand; PAM type: NRG; PAM sequence: TGG
cagagctgtagcagaagcag

SEQ ID NO: 11819 - DNA, 20 bp, Artificial Sequence
  Description of Artificial Sequence: Synthetic oligonucleotide
  Target: AGXT; (+) strand; PAM type: NRG; PAM sequence: GGG
agagctgtagcagaagcagt

SEQ ID NO: 11820 - DNA, 20 bp, Artificial Sequence
  Description of Artificial Sequence: Synthetic oligonucleotide
  Target: AGXT; (+) strand; PAM type: NRG; PAM sequence: AAG
gctgtagcagaagcagtggg

SEQ ID NO: 11821 - DNA, 20 bp, Artificial Sequence
  Description of Artificial Sequence: Synthetic oligonucleotide
  Target: AGXT; (+) strand; PAM type: NRG; PAM sequence: GAG
tgtagcagaagcagtgggaa

SEQ ID NO: 11822 - DNA, 20 bp, Artificial Sequence
  Description of Artificial Sequence: Synthetic oligonucleotide
  Target: AGXT; (+) strand; PAM type: NRG; PAM sequence: AGG
gtagcagaagcagtgggaag

SEQ ID NO: 11823 - DNA, 20 bp, Artificial Sequence
  Description of Artificial Sequence: Synthetic oligonucleotide
  Target: AGXT; (+) strand; PAM type: NRG; PAM sequence: AAG
gcagaagcagtgggaagagg

SEQ ID NO: 11824 - DNA, 20 bp, Artificial Sequence
  Description of Artificial Sequence: Synthetic oligonucleotide
  Target: AGXT; (+) strand; PAM type: NRG; PAM sequence: AGG
cagaagcagtgggaagagga

SEQ ID NO: 11825 - DNA, 20 bp, Artificial Sequence
  Description of Artificial Sequence: Synthetic oligonucleotide
  Target: AGXT; (+) strand; PAM type: NRG; PAM sequence: GGG
agaagcagtgggaagaggaa

SEQ ID NO: 11826 - DNA, 20 bp, Artificial Sequence
  Description of Artificial Sequence: Synthetic oligonucleotide
  Target: AGXT; (+) strand; PAM type: NRG; PAM sequence: CAG
gcagtgggaagaggaagggc

SEQ ID NO: 11827 - DNA, 20 bp, Artificial Sequence
  Description of Artificial Sequence: Synthetic oligonucleotide
  Target: AGXT; (+) strand; PAM type: NRG; PAM sequence: AGG
cagtgggaagaggaagggcc

SEQ ID NO: 11828 - DNA, 20 bp, Artificial Sequence
  Description of Artificial Sequence: Synthetic oligonucleotide
  Target: AGXT; (+) strand; PAM type: NRG; PAM sequence: GGG
agtgggaagaggaagggcca

SEQ ID NO: 11829 - DNA, 20 bp, Artificial Sequence
  Description of Artificial Sequence: Synthetic oligonucleotide
  Target: AGXT; (+) strand; PAM type: NRG; PAM sequence: CAG
aagaggaagggccagggctc

SEQ ID NO: 11830 - DNA, 20 bp, Artificial Sequence
  Description of Artificial Sequence: Synthetic oligonucleotide
  Target: AGXT; (+) strand; PAM type: NRG; PAM sequence: CAG
gggccagggctccagtcaat

SEQ ID NO: 11831 - DNA, 20 bp, Artificial Sequence
  Description of Artificial Sequence: Synthetic oligonucleotide
  Target: AGXT; (+) strand; PAM type: NRG; PAM sequence: AGG
ggccagggctccagtcaatc

SEQ ID NO: 11832 - DNA, 20 bp, Artificial Sequence
  Description of Artificial Sequence: Synthetic oligonucleotide
  Target: AGXT; (+) strand; PAM type: NRG; PAM sequence: TGG
ggctccagtcaatcaggcgt

SEQ ID NO: 11833 - DNA, 20 bp, Artificial Sequence
  Description of Artificial Sequence: Synthetic oligonucleotide
  Target: AGXT; (+) strand; PAM type: NRG; PAM sequence: GGG
gctccagtcaatcaggcgtt

SEQ ID NO: 11834 - DNA, 20 bp, Artificial Sequence
  Description of Artificial Sequence: Synthetic oligonucleotide
  Target: AGXT; (+) strand; PAM type: NRG; PAM sequence: CAG
cacccctctgcccaaccccc

SEQ ID NO: 11835 - DNA, 20 bp, Artificial Sequence
  Description of Artificial Sequence: Synthetic oligonucleotide
  Target: AGXT; (+) strand; PAM type: NRG; PAM sequence: GAG
cccctctgcccaacccccca

SEQ ID NO: 11836 - DNA, 20 bp, Artificial Sequence
  Description of Artificial Sequence: Synthetic oligonucleotide
  Target: AGXT; (+) strand; PAM type: NRG; PAM sequence: AGG
ccctctgcccaaccccccag

SEQ ID NO: 11837 - DNA, 20 bp, Artificial Sequence
  Description of Artificial Sequence: Synthetic oligonucleotide
  Target: AGXT; (+) strand; PAM type: NRG; PAM sequence: CAG
tgcccaaccccccagaggct

SEQ ID NO: 11838 - DNA, 20 bp, Artificial Sequence
  Description of Artificial Sequence: Synthetic oligonucleotide
  Target: AGXT; (+) strand; PAM type: NRG; PAM sequence: CAG
acatctgccctgcgccctgc

SEQ ID NO: 11839 - DNA, 20 bp, Artificial Sequence
  Description of Artificial Sequence: Synthetic oligonucleotide
  Target: AGXT; (+) strand; PAM type: NRG; PAM sequence: AGG
catctgccctgcgccctgcc

SEQ ID NO: 11840 - DNA, 20 bp, Artificial Sequence
  Description of Artificial Sequence: Synthetic oligonucleotide
  Target: AGXT; (+) strand; PAM type: NRG; PAM sequence: TAG
gcgccctgccaggctgccca

SEQ ID NO: 11841 - DNA, 20 bp, Artificial Sequence
  Description of Artificial Sequence: Synthetic oligonucleotide
  Target: AGXT; (+) strand; PAM type: NRG; PAM sequence: CAG
ccctgccaggctgcccatag

SEQ ID NO: 11842 - DNA, 20 bp, Artificial Sequence
  Description of Artificial Sequence: Synthetic oligonucleotide
  Target: AGXT; (+) strand; PAM type: NRG; PAM sequence: GAG
gccaggctgcccatagcagt

SEQ ID NO: 11843 - DNA, 20 bp, Artificial Sequence
  Description of Artificial Sequence: Synthetic oligonucleotide
  Target: AGXT; (+) strand; PAM type: NRG; PAM sequence: CAG
atagcagtgagcaccactgt

SEQ ID NO: 11844 - DNA, 20 bp, Artificial Sequence
  Description of Artificial Sequence: Synthetic oligonucleotide
  Target: AGXT; (+) strand; PAM type: NRG; PAM sequence: AGG
tagcagtgagcaccactgtc

SEQ ID NO: 11845 - DNA, 20 bp, Artificial Sequence
  Description of Artificial Sequence: Synthetic oligonucleotide
  Target: AGXT; (+) strand; PAM type: NRG; PAM sequence: GGG
agcagtgagcaccactgtca

SEQ ID NO: 11846 - DNA, 20 bp, Artificial Sequence
  Description of Artificial Sequence: Synthetic oligonucleotide
  Target: AGXT; (+) strand; PAM type: NRG; PAM sequence: CAG
ccactgtcagggtcacctcg

SEQ ID NO: 11847 - DNA, 20 bp, Artificial Sequence
  Description of Artificial Sequence: Synthetic oligonucleotide
  Target: AGXT; (+) strand; PAM type: NRG; PAM sequence: AGG
cactgtcagggtcacctcgc

SEQ ID NO: 11848 - DNA, 20 bp, Artificial Sequence
  Description of Artificial Sequence: Synthetic oligonucleotide
  Target: AGXT; (+) strand; PAM type: NRG; PAM sequence: GGG
actgtcagggtcacctcgca

SEQ ID NO: 11849 - DNA, 20 bp, Artificial Sequence
  Description of Artificial Sequence: Synthetic oligonucleotide
  Target: AGXT; (+) strand; PAM type: NRG; PAM sequence: CAG
acctcgcagggaacctcaac

SEQ ID NO: 11850 - DNA, 20 bp, Artificial Sequence
  Description of Artificial Sequence: Synthetic oligonucleotide
  Target: AGXT; (+) strand; PAM type: NRG; PAM sequence: AGG
cctcgcagggaacctcaacc

SEQ ID NO: 11851 - DNA, 20 bp, Artificial Sequence
  Description of Artificial Sequence: Synthetic oligonucleotide
  Target: AGXT; (+) strand; PAM type: NRG; PAM sequence: CGG
gcagggaacctcaaccaggc

SEQ ID NO: 11852 - DNA, 20 bp, Artificial Sequence
  Description of Artificial Sequence: Synthetic oligonucleotide
  Target: AGXT; (+) strand; PAM type: NRG; PAM sequence: GAG
gaacctcaaccaggccggcc

SEQ ID NO: 11853 - DNA, 20 bp, Artificial Sequence
  Description of Artificial Sequence: Synthetic oligonucleotide
  Target: AGXT; (+) strand; PAM type: NRG; PAM sequence: AGG
aacctcaaccaggccggccg

SEQ ID NO: 11854 - DNA, 20 bp, Artificial Sequence
  Description of Artificial Sequence: Synthetic oligonucleotide
  Target: AGXT; (+) strand; PAM type: NRG; PAM sequence: GGG
acctcaaccaggccggccga

SEQ ID NO: 11855 - DNA, 20 bp, Artificial Sequence
  Description of Artificial Sequence: Synthetic oligonucleotide
  Target: AGXT; (+) strand; PAM type: NRG; PAM sequence: GGG
cctcaaccaggccggccgag

SEQ ID NO: 11856 - DNA, 20 bp, Artificial Sequence
  Description of Artificial Sequence: Synthetic oligonucleotide
  Target: AGXT; (+) strand; PAM type: NRG; PAM sequence: AAG
accaggccggccgaggggcc

SEQ ID NO: 11857 - DNA, 20 bp, Artificial Sequence
  Description of Artificial Sequence: Synthetic oligonucleotide
  Target: AGXT; (+) strand; PAM type: NRG; PAM sequence: AGG
ccaggccggccgaggggcca

SEQ ID NO: 11858 - DNA, 20 bp, Artificial Sequence
  Description of Artificial Sequence: Synthetic oligonucleotide
  Target: AGXT; (+) strand; PAM type: NRG; PAM sequence: GAG
aggccggccgaggggccaag

SEQ ID NO: 11859 - DNA, 20 bp, Artificial Sequence
  Description of Artificial Sequence: Synthetic oligonucleotide
  Target: AGXT; (+) strand; PAM type: NRG; PAM sequence: CGG
ctcctgtgcccatccgctta

SEQ ID NO: 11860 - DNA, 20 bp, Artificial Sequence
  Description of Artificial Sequence: Synthetic oligonucleotide
  Target: AGXT; (+) strand; PAM type: NRG; PAM sequence: GGG
tcctgtgcccatccgcttac

SEQ ID NO: 11861 - DNA, 20 bp, Artificial Sequence
  Description of Artificial Sequence: Synthetic oligonucleotide
  Target: AGXT; (+) strand; PAM type: NRG; PAM sequence: GAG
ctgtgcccatccgcttacgg

SEQ ID NO: 11862 - DNA, 20 bp, Artificial Sequence
  Description of Artificial Sequence: Synthetic oligonucleotide
  Target: AGXT; (+) strand; PAM type: NRG; PAM sequence: GAG
gtgcccatccgcttacggga

SEQ ID NO: 11863 - DNA, 20 bp, Artificial Sequence
  Description of Artificial Sequence: Synthetic oligonucleotide
  Target: AGXT; (+) strand; PAM type: NRG; PAM sequence: GAG
gcccatccgcttacgggaga

SEQ ID NO: 11864 - DNA, 20 bp, Artificial Sequence
  Description of Artificial Sequence: Synthetic oligonucleotide
  Target: AGXT; (+) strand; PAM type: NRG; PAM sequence: CGG
cctgcacattgcatccactg

SEQ ID NO: 11865 - DNA, 20 bp, Artificial Sequence
  Description of Artificial Sequence: Synthetic oligonucleotide
  Target: AGXT; (+) strand; PAM type: NRG; PAM sequence: TGG
gtgcctgcccacccactcca

SEQ ID NO: 11866 - DNA, 20 bp, Artificial Sequence
  Description of Artificial Sequence: Synthetic oligonucleotide
  Target: AGXT; (+) strand; PAM type: NRG; PAM sequence: GGG
tgcctgcccacccactccat

SEQ ID NO: 11867 - DNA, 20 bp, Artificial Sequence
  Description of Artificial Sequence: Synthetic oligonucleotide
  Target: AGXT; (+) strand; PAM type: NRG; PAM sequence: GAG
cctgcccacccactccatgg

SEQ ID NO: 11868 - DNA, 20 bp, Artificial Sequence
  Description of Artificial Sequence: Synthetic oligonucleotide
  Target: AGXT; (+) strand; PAM type: NRG; PAM sequence: CAG
tgggagcctgtctgtttctg

SEQ ID NO: 11869 - DNA, 20 bp, Artificial Sequence
  Description of Artificial Sequence: Synthetic oligonucleotide
  Target: AGXT; (+) strand; PAM type: NRG; PAM sequence: GAG
ggagcctgtctgtttctgca

SEQ ID NO: 11870 - DNA, 20 bp, Artificial Sequence
  Description of Artificial Sequence: Synthetic oligonucleotide
  Target: AGXT; (+) strand; PAM type: NRG; PAM sequence: TGG
ctgcagagcccctcctgatt

SEQ ID NO: 11871 - DNA, 20 bp, Artificial Sequence
  Description of Artificial Sequence: Synthetic oligonucleotide
  Target: AGXT; (+) strand; PAM type: NRG; PAM sequence: GGG
tgcagagcccctcctgattt

SEQ ID NO: 11872 - DNA, 20 bp, Artificial Sequence
  Description of Artificial Sequence: Synthetic oligonucleotide
  Target: AGXT; (+) strand; PAM type: NRG; PAM sequence: GAG
cagagcccctcctgatttgg

SEQ ID NO: 11873 - DNA, 20 bp, Artificial Sequence
  Description of Artificial Sequence: Synthetic oligonucleotide
  Target: AGXT; (+) strand; PAM type: NRG; PAM sequence: CAG
cctcctgatttgggagttct

SEQ ID NO: 11874 - DNA, 20 bp, Artificial Sequence
  Description of Artificial Sequence: Synthetic oligonucleotide
  Target: AGXT; (+) strand; PAM type: NRG; PAM sequence: AGG
ctcctgatttgggagttctc

SEQ ID NO: 11875 - DNA, 20 bp, Artificial Sequence
  Description of Artificial Sequence: Synthetic oligonucleotide
  Target: AGXT; (+) strand; PAM type: NRG; PAM sequence: CAG
ctgatttgggagttctcagg

SEQ ID NO: 11876 - DNA, 20 bp, Artificial Sequence
  Description of Artificial Sequence: Synthetic oligonucleotide
  Target: AGXT; (+) strand; PAM type: NRG; PAM sequence: AGG
tgatttgggagttctcaggc

SEQ ID NO: 11877 - DNA, 20 bp, Artificial Sequence
  Description of Artificial Sequence: Synthetic oligonucleotide
  Target: AGXT; (+) strand; PAM type: NRG; PAM sequence: AAG
tttgggagttctcaggcagg

SEQ ID NO: 11878 - DNA, 20 bp, Artificial Sequence
  Description of Artificial Sequence: Synthetic oligonucleotide
  Target: AGXT; (+) strand; PAM type: NRG; PAM sequence: AGG
ttgggagttctcaggcagga

SEQ ID NO: 11879 - DNA, 20 bp, Artificial Sequence
  Description of Artificial Sequence: Synthetic oligonucleotide
  Target: AGXT; (+) strand; PAM type: NRG; PAM sequence: GGG
tgggagttctcaggcaggaa

SEQ ID NO: 11880 - DNA, 20 bp, Artificial Sequence
  Description of Artificial Sequence: Synthetic oligonucleotide
  Target: AGXT; (+) strand; PAM type: NRG; PAM sequence: GAG
ggagttctcaggcaggaagg

SEQ ID NO: 11881 - DNA, 20 bp, Artificial Sequence
  Description of Artificial Sequence: Synthetic oligonucleotide
  Target: AGXT; (+) strand; PAM type: NRG; PAM sequence: AGG
gagttctcaggcaggaaggg

SEQ ID NO: 11882 - DNA, 20 bp, Artificial Sequence
  Description of Artificial Sequence: Synthetic oligonucleotide
  Target: AGXT; (+) strand; PAM type: NRG; PAM sequence: GGG
agttctcaggcaggaaggga

SEQ ID NO: 11883 - DNA, 20 bp, Artificial Sequence
  Description of Artificial Sequence: Synthetic oligonucleotide
  Target: AGXT; (+) strand; PAM type: NRG; PAM sequence: TGG
ggcaggaagggagggatttc

SEQ ID NO: 11884 - DNA, 20 bp, Artificial Sequence
  Description of Artificial Sequence: Synthetic oligonucleotide
  Target: AGXT; (+) strand; PAM type: NRG; PAM sequence: GGG
gcaggaagggagggatttct

SEQ ID NO: 11885 - DNA, 20 bp, Artificial Sequence
  Description of Artificial Sequence: Synthetic oligonucleotide
  Target: AGXT; (+) strand; PAM type: NRG; PAM sequence: AAG
gatcctcaaactactactga

SEQ ID NO: 11886 - DNA, 20 bp, Artificial Sequence
  Description of Artificial Sequence: Synthetic oligonucleotide
  Target: AGXT; (+) strand; PAM type: NRG; PAM sequence: CAG
cctcaaactactactgaaag

SEQ ID NO: 11887 - DNA, 20 bp, Artificial Sequence
  Description of Artificial Sequence: Synthetic oligonucleotide
  Target: AGXT; (+) strand; PAM type: NRG; PAM sequence: AGG
ctcaaactactactgaaagc

SEQ ID NO: 11888 - DNA, 20 bp, Artificial Sequence
  Description of Artificial Sequence: Synthetic oligonucleotide
  Target: AGXT; (+) strand; PAM type: NRG; PAM sequence: GGG
tcaaactactactgaaagca

SEQ ID NO: 11889 - DNA, 20 bp, Artificial Sequence
  Description of Artificial Sequence: Synthetic oligonucleotide
  Target: AGXT; (+) strand; PAM type: NRG; PAM sequence: TGG
tactactgaaagcagggacc

SEQ ID NO: 11890 - DNA, 20 bp, Artificial Sequence
  Description of Artificial Sequence: Synthetic oligonucleotide
  Target: AGXT; (+) strand; PAM type: NRG; PAM sequence: GGG
actactgaaagcagggacct

SEQ ID NO: 11891 - DNA, 20 bp, Artificial Sequence
  Description of Artificial Sequence: Synthetic oligonucleotide
  Target: AGXT; (+) strand; PAM type: NRG; PAM sequence: GGG
ctactgaaagcagggacctg

SEQ ID NO: 11892 - DNA, 20 bp, Artificial Sequence
  Description of Artificial Sequence: Synthetic oligonucleotide
  Target: AGXT; (+) strand; PAM type: NRG; PAM sequence: GAG
actgaaagcagggacctggg

SEQ ID NO: 11893 - DNA, 20 bp, Artificial Sequence
  Description of Artificial Sequence: Synthetic oligonucleotide
  Target: AGXT; (+) strand; PAM type: NRG; PAM sequence: AGG
ctgaaagcagggacctgggg

SEQ ID NO: 11894 - DNA, 20 bp, Artificial Sequence
  Description of Artificial Sequence: Synthetic oligonucleotide
  Target: AGXT; (+) strand; PAM type: NRG; PAM sequence: GGG
tgaaagcagggacctgggga

SEQ ID NO: 11895 - DNA, 20 bp, Artificial Sequence
  Description of Artificial Sequence: Synthetic oligonucleotide
  Target: AGXT; (+) strand; PAM type: NRG; PAM sequence: CAG
cagggacctggggagggccc

SEQ ID NO: 11896 - DNA, 20 bp, Artificial Sequence
  Description of Artificial Sequence: Synthetic oligonucleotide
  Target: AGXT; (+) strand; PAM type: NRG; PAM sequence: AGG
agggacctggggagggcccc

SEQ ID NO: 11897 - DNA, 20 bp, Artificial Sequence
  Description of Artificial Sequence: Synthetic oligonucleotide
  Target: AGXT; (+) strand; PAM type: NRG; PAM sequence: GGG
gggacctggggagggcccca

SEQ ID NO: 11898 - DNA, 20 bp, Artificial Sequence
  Description of Artificial Sequence: Synthetic oligonucleotide
  Target: AGXT; (+) strand; PAM type: NRG; PAM sequence: CGG
tggggagggccccagggaca

SEQ ID NO: 11899 - DNA, 20 bp, Artificial Sequence
  Description of Artificial Sequence: Synthetic oligonucleotide
  Target: AGXT; (+) strand; PAM type: NRG; PAM sequence: TGG
ggccccagggacacggtgcc

SEQ ID NO: 11900 - DNA, 20 bp, Artificial Sequence
  Description of Artificial Sequence: Synthetic oligonucleotide
  Target: AGXT; (+) strand; PAM type: NRG; PAM sequence: GGG
gccccagggacacggtgcct

SEQ ID NO: 11901 - DNA, 20 bp, Artificial Sequence
  Description of Artificial Sequence: Synthetic oligonucleotide
  Target: AGXT; (+) strand; PAM type: NRG; PAM sequence: GGG
ccccagggacacggtgcctg

SEQ ID NO: 11902 - DNA, 20 bp, Artificial Sequence
  Description of Artificial Sequence: Synthetic oligonucleotide
  Target: AGXT; (+) strand; PAM type: NRG; PAM sequence: TGG
cagggacacggtgcctgggg

SEQ ID NO: 11903 - DNA, 20 bp, Artificial Sequence
  Description of Artificial Sequence: Synthetic oligonucleotide
  Target: AGXT; (+) strand; PAM type: NRG; PAM sequence: CAG
ggacacggtgcctggggtgg

SEQ ID NO: 11904 - DNA, 20 bp, Artificial Sequence
  Description of Artificial Sequence: Synthetic oligonucleotide
  Target: AGXT; (+) strand; PAM type: NRG; PAM sequence: AGG
gacacggtgcctggggtggc

SEQ ID NO: 11905 - DNA, 20 bp, Artificial Sequence
  Description of Artificial Sequence: Synthetic oligonucleotide
  Target: AGXT; (+) strand; PAM type: NRG; PAM sequence: GGG
acacggtgcctggggtggca

SEQ ID NO: 11906 - DNA, 20 bp, Artificial Sequence
  Description of Artificial Sequence: Synthetic oligonucleotide
  Target: AGXT; (+) strand; PAM type: NRG; PAM sequence: TGG
tggggtggcagggctgtccc

SEQ ID NO: 11907 - DNA, 20 bp, Artificial Sequence
  Description of Artificial Sequence: Synthetic oligonucleotide
  Target: AGXT; (+) strand; PAM type: NRG; PAM sequence: GGG
ggggtggcagggctgtccct

SEQ ID NO: 11908 - DNA, 20 bp, Artificial Sequence
  Description of Artificial Sequence: Synthetic oligonucleotide
  Target: AGXT; (+) strand; PAM type: NRG; PAM sequence: GGG
gggtggcagggctgtccctg

SEQ ID NO: 11909 - DNA, 20 bp, Artificial Sequence
  Description of Artificial Sequence: Synthetic oligonucleotide
  Target: AGXT; (+) strand; PAM type: NRG; PAM sequence: CAG
gcagggctgtccctggggac

SEQ ID NO: 11910 - DNA, 20 bp, Artificial Sequence
  Description of Artificial Sequence: Synthetic oligonucleotide
  Target: AGXT; (+) strand; PAM type: NRG; PAM sequence: CAG
gctgtccctggggaccagca

SEQ ID NO: 11911 - DNA, 20 bp, Artificial Sequence
  Description of Artificial Sequence: Synthetic oligonucleotide
  Target: AGXT; (+) strand; PAM type: NRG; PAM sequence: CAG
gtccctggggaccagcacag

SEQ ID NO: 11912 - DNA, 20 bp, Artificial Sequence
  Description of Artificial Sequence: Synthetic oligonucleotide
  Target: AGXT; (+) strand; PAM type: NRG; PAM sequence: GAG
ccctggggaccagcacagca

SEQ ID NO: 11913 - DNA, 20 bp, Artificial Sequence
  Description of Artificial Sequence: Synthetic oligonucleotide
  Target: AGXT; (+) strand; PAM type: NRG; PAM sequence: AGG
cctggggaccagcacagcag

SEQ ID NO: 11914 - DNA, 20 bp, Artificial Sequence
  Description of Artificial Sequence: Synthetic oligonucleotide
  Target: AGXT; (+) strand; PAM type: NRG; PAM sequence: GGG
ctggggaccagcacagcaga

SEQ ID NO: 11915 - DNA, 20 bp, Artificial Sequence
  Description of Artificial Sequence: Synthetic oligonucleotide
  Target: AGXT; (+) strand; PAM type: NRG; PAM sequence: GAG
ggggaccagcacagcagagg

SEQ ID NO: 11916 - DNA, 20 bp, Artificial Sequence
  Description of Artificial Sequence: Synthetic oligonucleotide
  Target: AGXT; (+) strand; PAM type: NRG; PAM sequence: AAG
gaccagcacagcagagggag

SEQ ID NO: 11917 - DNA, 20 bp, Artificial Sequence
  Description of Artificial Sequence: Synthetic oligonucleotide
  Target: AGXT; (+) strand; PAM type: NRG; PAM sequence: CAG
agaagctgcgctaaaacgct

SEQ ID NO: 11918 - DNA, 20 bp, Artificial Sequence
  Description of Artificial Sequence: Synthetic oligonucleotide
  Target: AGXT; (+) strand; PAM type: NRG; PAM sequence: AGG
gaagctgcgctaaaacgctc

SEQ ID NO: 11919 - DNA, 20 bp, Artificial Sequence
  Description of Artificial Sequence: Synthetic oligonucleotide
  Target: AGXT; (+) strand; PAM type: NRG; PAM sequence: GAG
gcgctaaaacgctcaggcct

SEQ ID NO: 11920 - DNA, 20 bp, Artificial Sequence
  Description of Artificial Sequence: Synthetic oligonucleotide
  Target: AGXT; (+) strand; PAM type: NRG; PAM sequence: AGG
cgctaaaacgctcaggcctg

SEQ ID NO: 11921 - DNA, 20 bp, Artificial Sequence
  Description of Artificial Sequence: Synthetic oligonucleotide
  Target: AGXT; (+) strand; PAM type: NRG; PAM sequence: TGG
aacgctcaggcctgaggtca

SEQ ID NO: 11922 - DNA, 20 bp, Artificial Sequence
  Description of Artificial Sequence: Synthetic oligonucleotide
  Target: AGXT; (+) strand; PAM type: NRG; PAM sequence: CAG
ctgaggtcatggctgccacg

SEQ ID NO: 11923 - DNA, 20 bp, Artificial Sequence
  Description of Artificial Sequence: Synthetic oligonucleotide
  Target: AGXT; (+) strand; PAM type: NRG; PAM sequence: CAG
aggtcatggctgccacgcag

SEQ ID NO: 11924 - DNA, 20 bp, Artificial Sequence
  Description of Artificial Sequence: Synthetic oligonucleotide
  Target: AGXT; (+) strand; PAM type: NRG; PAM sequence: CAG
ggctgccacgcagcagtgcc

SEQ ID NO: 11925 - DNA, 20 bp, Artificial Sequence
  Description of Artificial Sequence: Synthetic oligonucleotide
  Target: AGXT; (+) strand; PAM type: NRG; PAM sequence: CAG
gcagtgcccagatttgaacc

SEQ ID NO: 11926 - DNA, 20 bp, Artificial Sequence
  Description of Artificial Sequence: Synthetic oligonucleotide
  Target: AGXT; (+) strand; PAM type: NRG; PAM sequence: AGG
cagtgcccagatttgaaccc

SEQ ID NO: 11927 - DNA, 20 bp, Artificial Sequence
  Description of Artificial Sequence: Synthetic oligonucleotide
  Target: AGXT; (+) strand; PAM type: NRG; PAM sequence: CGG
atctcccctgctatcgtgta

SEQ ID NO: 11928 - DNA, 20 bp, Artificial Sequence
  Description of Artificial Sequence: Synthetic oligonucleotide
  Target: AGXT; (+) strand; PAM type: NRG; PAM sequence: TGG
tgctatcgtgtacggattcg

SEQ ID NO: 11929 - DNA, 20 bp, Artificial Sequence
  Description of Artificial Sequence: Synthetic oligonucleotide
  Target: AGXT; (+) strand; PAM type: NRG; PAM sequence: TAG
tatcgtgtacggattcgtgg

SEQ ID NO: 11930 - DNA, 20 bp, Artificial Sequence
  Description of Artificial Sequence: Synthetic oligonucleotide
  Target: AGXT; (+) strand; PAM type: NRG; PAM sequence: AGG
atcgtgtacggattcgtggt

SEQ ID NO: 11931 - DNA, 20 bp, Artificial Sequence
  Description of Artificial Sequence: Synthetic oligonucleotide
  Target: AGXT; (+) strand; PAM type: NRG; PAM sequence: GGG
tcgtgtacggattcgtggta

SEQ ID NO: 11932 - DNA, 20 bp, Artificial Sequence
  Description of Artificial Sequence: Synthetic oligonucleotide
  Target: AGXT; (+) strand; PAM type: NRG; PAM sequence: TAG
acggattcgtggtagggtcg

SEQ ID NO: 11933 - DNA, 20 bp, Artificial Sequence
  Description of Artificial Sequence: Synthetic oligonucleotide
  Target: AGXT; (+) strand; PAM type: NRG; PAM sequence: CAG
gtggtagggtcgtagcctac

SEQ ID NO: 11934 - DNA, 20 bp, Artificial Sequence
  Description of Artificial Sequence: Synthetic oligonucleotide
  Target: AGXT; (+) strand; PAM type: NRG; PAM sequence: TAG
gtcgtagcctaccagcccat

SEQ ID NO: 11935 - DNA, 20 bp, Artificial Sequence
  Description of Artificial Sequence: Synthetic oligonucleotide
  Target: AGXT; (+) strand; PAM type: NRG; PAM sequence: TAG
tagcctaccagcccattagc

SEQ ID NO: 11936 - DNA, 20 bp, Artificial Sequence
  Description of Artificial Sequence: Synthetic oligonucleotide
  Target: AGXT; (+) strand; PAM type: NRG; PAM sequence: AGG
agcctaccagcccattagct

SEQ ID NO: 11937 - DNA, 20 bp, Artificial Sequence
  Description of Artificial Sequence: Synthetic oligonucleotide
  Target: AGXT; (+) strand; PAM type: NRG; PAM sequence: CAG
ctaccagcccattagctagg

SEQ ID NO: 11938 - DNA, 20 bp, Artificial Sequence
  Description of Artificial Sequence: Synthetic oligonucleotide
  Target: AGXT; (+) strand; PAM type: NRG; PAM sequence: AGG
taccagcccattagctaggc

SEQ ID NO: 11939 - DNA, 20 bp, Artificial Sequence
  Description of Artificial Sequence: Synthetic oligonucleotide
  Target: AGXT; (+) strand; PAM type: NRG; PAM sequence: TGG
tagctaggcaggcatcccgc

SEQ ID NO: 11940 - DNA, 20 bp, Artificial Sequence
  Description of Artificial Sequence: Synthetic oligonucleotide
  Target: AGXT; (+) strand; PAM type: NRG; PAM sequence: TGG
aggcaggcatcccgctggac

SEQ ID NO: 11941 - DNA, 20 bp, Artificial Sequence
  Description of Artificial Sequence: Synthetic oligonucleotide
  Target: AGXT; (+) strand; PAM type: NRG; PAM sequence: GAG
ccgctggactggcctgccct

SEQ ID NO: 11942 - DNA, 20 bp, Artificial Sequence
  Description of Artificial Sequence: Synthetic oligonucleotide
  Target: AGXT; (+) strand; PAM type: NRG; PAM sequence: AGG
cgctggactggcctgccctg

SEQ ID NO: 11943 - DNA, 20 bp, Artificial Sequence
  Description of Artificial Sequence: Synthetic oligonucleotide
  Target: AGXT; (+) strand; PAM type: NRG; PAM sequence: TGG
tggactggcctgccctgagg

SEQ ID NO: 11944 - DNA, 20 bp, Artificial Sequence
  Description of Artificial Sequence: Synthetic oligonucleotide
  Target: AGXT; (+) strand; PAM type: NRG; PAM sequence: GGG
ggactggcctgccctgaggt

SEQ ID NO: 11945 - DNA, 20 bp, Artificial Sequence
  Description of Artificial Sequence: Synthetic oligonucleotide
  Target: AGXT; (+) strand; PAM type: NRG; PAM sequence: GAG
aggtgggactcacccgtccc

SEQ ID NO: 11946 - DNA, 20 bp, Artificial Sequence
  Description of Artificial Sequence: Synthetic oligonucleotide
  Target: AGXT; (+) strand; PAM type: NRG; PAM sequence: CAG
ccgagcaaaccacccatcta

SEQ ID NO: 11947 - DNA, 20 bp, Artificial Sequence
  Description of Artificial Sequence: Synthetic oligonucleotide
  Target: AGXT; (+) strand; PAM type: NRG; PAM sequence: AGG
cgagcaaaccacccatctac

SEQ ID NO: 11948 - DNA, 20 bp, Artificial Sequence
  Description of Artificial Sequence: Synthetic oligonucleotide
  Target: AGXT; (+) strand; PAM type: NRG; PAM sequence: CGG
aggcatcgacatcctgtact

SEQ ID NO: 11949 - DNA, 20 bp, Artificial Sequence
  Description of Artificial Sequence: Synthetic oligonucleotide
  Target: AGXT; (+) strand; PAM type: NRG; PAM sequence: GGG
ggcatcgacatcctgtactc

SEQ ID NO: 11950 - DNA, 20 bp, Artificial Sequence
  Description of Artificial Sequence: Synthetic oligonucleotide
  Target: AGXT; (+) strand; PAM type: NRG; PAM sequence: CAG
acatcctgtactcgggctcc

SEQ ID NO: 11951 - DNA, 20 bp, Artificial Sequence
  Description of Artificial Sequence: Synthetic oligonucleotide
  Target: AGXT; (+) strand; PAM type: NRG; PAM sequence: AAG
tcctgtactcgggctcccag

SEQ ID NO: 11952 - DNA, 20 bp, Artificial Sequence
  Description of Artificial Sequence: Synthetic oligonucleotide
  Target: AGXT; (+) strand; PAM type: NRG; PAM sequence: AGG
cctgtactcgggctcccaga

SEQ ID NO: 11953 - DNA, 20 bp, Artificial Sequence
  Description of Artificial Sequence: Synthetic oligonucleotide
  Target: AGXT; (+) strand; PAM type: NRG; PAM sequence: CAG
gaaggccctgaacgcccctc

SEQ ID NO: 11954 - DNA, 20 bp, Artificial Sequence
  Description of Artificial Sequence: Synthetic oligonucleotide
  Target: AGXT; (+) strand; PAM type: NRG; PAM sequence: AGG
aaggccctgaacgcccctcc

SEQ ID NO: 11955 - DNA, 20 bp, Artificial Sequence
  Description of Artificial Sequence: Synthetic oligonucleotide
  Target: AGXT; (+) strand; PAM type: NRG; PAM sequence: GGG
aggccctgaacgcccctcca

SEQ ID NO: 11956 - DNA, 20 bp, Artificial Sequence
  Description of Artificial Sequence: Synthetic oligonucleotide
  Target: AGXT; (+) strand; PAM type: NRG; PAM sequence: CAG
gggacctcgctcatctcctt

SEQ ID NO: 11957 - DNA, 20 bp, Artificial Sequence
  Description of Artificial Sequence: Synthetic oligonucleotide
  Target: AGXT; (+) strand; PAM type: NRG; PAM sequence: AAG
cgctcatctccttcagtgac

SEQ ID NO: 11958 - DNA, 20 bp, Artificial Sequence
  Description of Artificial Sequence: Synthetic oligonucleotide
  Target: AGXT; (+) strand; PAM type: NRG; PAM sequence: AGG
gctcatctccttcagtgaca

SEQ ID NO: 11959 - DNA, 20 bp, Artificial Sequence
  Description of Artificial Sequence: Synthetic oligonucleotide
  Target: AGXT; (+) strand; PAM type: NRG; PAM sequence: AAG
tctccttcagtgacaaggcc

SEQ ID NO: 11960 - DNA, 20 bp, Artificial Sequence
  Description of Artificial Sequence: Synthetic oligonucleotide
  Target: AGXT; (+) strand; PAM type: NRG; PAM sequence: GAG
cttcagtgacaaggccaagt

SEQ ID NO: 11961 - DNA, 20 bp, Artificial Sequence
  Description of Artificial Sequence: Synthetic oligonucleotide
  Target: AGXT; (+) strand; PAM type: NRG; PAM sequence: CAG
aaggccaagtgagtgaccca

SEQ ID NO: 11962 - DNA, 20 bp, Artificial Sequence
  Description of Artificial Sequence: Synthetic oligonucleotide
  Target: AGXT; (+) strand; PAM type: NRG; PAM sequence: CAG
cacagaccctcacctctgtg

SEQ ID NO: 11963 - DNA, 20 bp, Artificial Sequence
  Description of Artificial Sequence: Synthetic oligonucleotide
  Target: AGXT; (+) strand; PAM type: NRG; PAM sequence: AGG
acagaccctcacctctgtgc

SEQ ID NO: 11964 - DNA, 20 bp, Artificial Sequence
  Description of Artificial Sequence: Synthetic oligonucleotide
  Target: AGXT; (+) strand; PAM type: NRG; PAM sequence: GGG
cagaccctcacctctgtgca

SEQ ID NO: 11965 - DNA, 20 bp, Artificial Sequence
  Description of Artificial Sequence: Synthetic oligonucleotide
  Target: AGXT; (+) strand; PAM type: NRG; PAM sequence: TGG
ccctcacctctgtgcagggc

SEQ ID NO: 11966 - DNA, 20 bp, Artificial Sequence
  Description of Artificial Sequence: Synthetic oligonucleotide
  Target: AGXT; (+) strand; PAM type: NRG; PAM sequence: GGG
cctcacctctgtgcagggct

SEQ ID NO: 11967 - DNA, 20 bp, Artificial Sequence
  Description of Artificial Sequence: Synthetic oligonucleotide
  Target: AGXT; (+) strand; PAM type: NRG; PAM sequence: CAG
tctgtgcagggctgggcttg

SEQ ID NO: 11968 - DNA, 20 bp, Artificial Sequence
  Description of Artificial Sequence: Synthetic oligonucleotide
  Target: AGXT; (+) strand; PAM type: NRG; PAM sequence: AGG
ctgtgcagggctgggcttgc

SEQ ID NO: 11969 - DNA, 20 bp, Artificial Sequence
  Description of Artificial Sequence: Synthetic oligonucleotide
  Target: AGXT; (+) strand; PAM type: NRG; PAM sequence: GGG
tgtgcagggctgggcttgca

SEQ ID NO: 11970 - DNA, 20 bp, Artificial Sequence
  Description of Artificial Sequence: Synthetic oligonucleotide
  Target: AGXT; (+) strand; PAM type: NRG; PAM sequence: GAG
tgcagggctgggcttgcagg

SEQ ID NO: 11971 - DNA, 20 bp, Artificial Sequence
  Description of Artificial Sequence: Synthetic oligonucleotide
  Target: AGXT; (+) strand; PAM type: NRG; PAM sequence: CAG
ggctgggcttgcagggagct

SEQ ID NO: 11972 - DNA, 20 bp, Artificial Sequence
  Description of Artificial Sequence: Synthetic oligonucleotide
  Target: AGXT; (+) strand; PAM type: NRG; PAM sequence: AGG
gctgggcttgcagggagctc

SEQ ID NO: 11973 - DNA, 20 bp, Artificial Sequence
  Description of Artificial Sequence: Synthetic oligonucleotide
  Target: AGXT; (+) strand; PAM type: NRG; PAM sequence: TGG
gggcttgcagggagctcagg

SEQ ID NO: 11974 - DNA, 20 bp, Artificial Sequence
  Description of Artificial Sequence: Synthetic oligonucleotide
  Target: AGXT; (+) strand; PAM type: NRG; PAM sequence: GAG
gcagggagctcaggtggccc

SEQ ID NO: 11975 - DNA, 20 bp, Artificial Sequence
  Description of Artificial Sequence: Synthetic oligonucleotide
  Target: AGXT; (+) strand; PAM type: NRG; PAM sequence: AGG
cagggagctcaggtggcccg

SEQ ID NO: 11976 - DNA, 20 bp, Artificial Sequence
  Description of Artificial Sequence: Synthetic oligonucleotide
  Target: AGXT; (+) strand; PAM type: NRG; PAM sequence: CGG
ggagctcaggtggcccgagg

SEQ ID NO: 11977 - DNA, 20 bp, Artificial Sequence
  Description of Artificial Sequence: Synthetic oligonucleotide
  Target: AGXT; (+) strand; PAM type: NRG; PAM sequence: GGG
gagctcaggtggcccgaggc

SEQ ID NO: 11978 - DNA, 20 bp, Artificial Sequence
  Description of Artificial Sequence: Synthetic oligonucleotide
  Target: AGXT; (+) strand; PAM type: NRG; PAM sequence: GAG
gctcaggtggcccgaggcgg

SEQ ID NO: 11979 - DNA, 20 bp, Artificial Sequence
  Description of Artificial Sequence: Synthetic oligonucleotide
  Target: AGXT; (+) strand; PAM type: NRG; PAM sequence: AGG
ctcaggtggcccgaggcggg

SEQ ID NO: 11980 - DNA, 20 bp, Artificial Sequence
  Description of Artificial Sequence: Synthetic oligonucleotide
  Target: AGXT; (+) strand; PAM type: NRG; PAM sequence: GGG
tcaggtggcccgaggcggga

SEQ ID NO: 11981 - DNA, 20 bp, Artificial Sequence
  Description of Artificial Sequence: Synthetic oligonucleotide
  Target: AGXT; (+) strand; PAM type: NRG; PAM sequence: GGG
caggtggcccgaggcgggag

SEQ ID NO: 11982 - DNA, 20 bp, Artificial Sequence
  Description of Artificial Sequence: Synthetic oligonucleotide
  Target: AGXT; (+) strand; PAM type: NRG; PAM sequence: CGG
gtggcccgaggcgggagggg

SEQ ID NO: 11983 - DNA, 20 bp, Artificial Sequence
  Description of Artificial Sequence: Synthetic oligonucleotide
  Target: AGXT; (+) strand; PAM type: NRG; PAM sequence: GGG
tggcccgaggcgggaggggc

SEQ ID NO: 11984 - DNA, 20 bp, Artificial Sequence
  Description of Artificial Sequence: Synthetic oligonucleotide
  Target: AGXT; (+) strand; PAM type: NRG; PAM sequence: GAG
gcccgaggcgggaggggcgg

SEQ ID NO: 11985 - DNA, 20 bp, Artificial Sequence
  Description of Artificial Sequence: Synthetic oligonucleotide
  Target: AGXT; (+) strand; PAM type: NRG; PAM sequence: CAG
gaggcgggaggggcgggagc

SEQ ID NO: 11986 - DNA, 20 bp, Artificial Sequence
  Description of Artificial Sequence: Synthetic oligonucleotide
  Target: AGXT; (+) strand; PAM type: NRG; PAM sequence: AGG
aggcgggaggggcgggagcc

SEQ ID NO: 11987 - DNA, 20 bp, Artificial Sequence
  Description of Artificial Sequence: Synthetic oligonucleotide
  Target: AGXT; (+) strand; PAM type: NRG; PAM sequence: CAG
cgggaggggcgggagccagg

SEQ ID NO: 11988 - DNA, 20 bp, Artificial Sequence
  Description of Artificial Sequence: Synthetic oligonucleotide
  Target: AGXT; (+) strand; PAM type: NRG; PAM sequence: AGG
gggaggggcgggagccaggc

SEQ ID NO: 11989 - DNA, 20 bp, Artificial Sequence
  Description of Artificial Sequence: Synthetic oligonucleotide
  Target: AGXT; (+) strand; PAM type: NRG; PAM sequence: AAG
aggggcgggagccaggcagg

SEQ ID NO: 11990 - DNA, 20 bp, Artificial Sequence
  Description of Artificial Sequence: Synthetic oligonucleotide
  Target: AGXT; (+) strand; PAM type: NRG; PAM sequence: AGG
ggggcgggagccaggcagga

SEQ ID NO: 11991 - DNA, 20 bp, Artificial Sequence
  Description of Artificial Sequence: Synthetic oligonucleotide
  Target: AGXT; (+) strand; PAM type: NRG; PAM sequence: GGG
gggcgggagccaggcaggaa

SEQ ID NO: 11992 - DNA, 20 bp, Artificial Sequence
  Description of Artificial Sequence: Synthetic oligonucleotide
  Target: AGXT; (+) strand; PAM type: NRG; PAM sequence: CAG
aagggctccccatgctcctc

SEQ ID NO: 11993 - DNA, 20 bp, Artificial Sequence
  Description of Artificial Sequence: Synthetic oligonucleotide
  Target: AGXT; (+) strand; PAM type: NRG; PAM sequence: TGG
ccccatgctcctccagcacc

SEQ ID NO: 11994 - DNA, 20 bp, Artificial Sequence
  Description of Artificial Sequence: Synthetic oligonucleotide
  Target: AGXT; (+) strand; PAM type: NRG; PAM sequence: TGG
gcgctctcccgcccaccctc

SEQ ID NO: 11995 - DNA, 20 bp, Artificial Sequence
  Description of Artificial Sequence: Synthetic oligonucleotide
  Target: AGXT; (+) strand; PAM type: NRG; PAM sequence: GGG
cgctctcccgcccaccctct

SEQ ID NO: 11996 - DNA, 20 bp, Artificial Sequence
  Description of Artificial Sequence: Synthetic oligonucleotide
  Target: AGXT; (+) strand; PAM type: NRG; PAM sequence: GAG
ctctcccgcccaccctctgg

SEQ ID NO: 11997 - DNA, 20 bp, Artificial Sequence
  Description of Artificial Sequence: Synthetic oligonucleotide
  Target: AGXT; (+) strand; PAM type: NRG; PAM sequence: AGG
tctcccgcccaccctctggg

SEQ ID NO: 11998 - DNA, 20 bp, Artificial Sequence
  Description of Artificial Sequence: Synthetic oligonucleotide
  Target: AGXT; (+) strand; PAM type: NRG; PAM sequence: AAG
gcccaccctctgggaggcca

SEQ ID NO: 11999 - DNA, 20 bp, Artificial Sequence
  Description of Artificial Sequence: Synthetic oligonucleotide
  Target: AGXT; (+) strand; PAM type: NRG; PAM sequence: AGG
cccaccctctgggaggccaa

SEQ ID NO: 12000 - DNA, 20 bp, Artificial Sequence
  Description of Artificial Sequence: Synthetic oligonucleotide
  Target: AGXT; (+) strand; PAM type: NRG; PAM sequence: CAG
ggccaaaggcactgcgttca

SEQ ID NO: 12001 - DNA, 20 bp, Artificial Sequence
  Description of Artificial Sequence: Synthetic oligonucleotide
  Target: AGXT; (+) strand; PAM type: NRG; PAM sequence: AGG
gccaaaggcactgcgttcac

SEQ ID NO: 12002 - DNA, 20 bp, Artificial Sequence
  Description of Artificial Sequence: Synthetic oligonucleotide
  Target: AGXT; (+) strand; PAM type: NRG; PAM sequence: GGG
ccaaaggcactgcgttcaca

SEQ ID NO: 12003 - DNA, 20 bp, Artificial Sequence
  Description of Artificial Sequence: Synthetic oligonucleotide
  Target: AGXT; (+) strand; PAM type: NRG; PAM sequence: GAG
aaaggcactgcgttcacagg

SEQ ID NO: 12004 - DNA, 20 bp, Artificial Sequence
  Description of Artificial Sequence: Synthetic oligonucleotide
  Target: AGXT; (+) strand; PAM type: NRG; PAM sequence: TGG
ggcactgcgttcacagggag

SEQ ID NO: 12005 - DNA, 20 bp, Artificial Sequence
  Description of Artificial Sequence: Synthetic oligonucleotide
  Target: AGXT; (+) strand; PAM type: NRG; PAM sequence: GGG
gcactgcgttcacagggagt

SEQ ID NO: 12006 - DNA, 20 bp, Artificial Sequence
  Description of Artificial Sequence: Synthetic oligonucleotide
  Target: AGXT; (+) strand; PAM type: NRG; PAM sequence: GGG
cactgcgttcacagggagtg

SEQ ID NO: 12007 - DNA, 20 bp, Artificial Sequence
  Description of Artificial Sequence: Synthetic oligonucleotide
  Target: AGXT; (+) strand; PAM type: NRG; PAM sequence: GAG
ctgcgttcacagggagtggg

SEQ ID NO: 12008 - DNA, 20 bp, Artificial Sequence
  Description of Artificial Sequence: Synthetic oligonucleotide
  Target: AGXT; (+) strand; PAM type: NRG; PAM sequence: AGG
tgcgttcacagggagtgggg

SEQ ID NO: 12009 - DNA, 20 bp, Artificial Sequence
  Description of Artificial Sequence: Synthetic oligonucleotide
  Target: AGXT; (+) strand; PAM type: NRG; PAM sequence: CGG
ttcacagggagtggggaggc

SEQ ID NO: 12010 - DNA, 20 bp, Artificial Sequence
  Description of Artificial Sequence: Synthetic oligonucleotide
  Target: AGXT; (+) strand; PAM type: NRG; PAM sequence: GGG
tcacagggagtggggaggcc

SEQ ID NO: 12011 - DNA, 20 bp, Artificial Sequence
  Description of Artificial Sequence: Synthetic oligonucleotide
  Target: AGXT; (+) strand; PAM type: NRG; PAM sequence: GAG
agggagtggggaggccgggc

SEQ ID NO: 12012 - DNA, 20 bp, Artificial Sequence
  Description of Artificial Sequence: Synthetic oligonucleotide
  Target: AGXT; (+) strand; PAM type: NRG; PAM sequence: AGG
gggagtggggaggccgggcg

SEQ ID NO: 12013 - DNA, 20 bp, Artificial Sequence
  Description of Artificial Sequence: Synthetic oligonucleotide
  Target: AGXT; (+) strand; PAM type: NRG; PAM sequence: GGG
ggagtggggaggccgggcga

SEQ ID NO: 12014 - DNA, 20 bp, Artificial Sequence
  Description of Artificial Sequence: Synthetic oligonucleotide
  Target: AGXT; (+) strand; PAM type: NRG; PAM sequence: GGG
gagtggggaggccgggcgag

SEQ ID NO: 12015 - DNA, 20 bp, Artificial Sequence
  Description of Artificial Sequence: Synthetic oligonucleotide
  Target: AGXT; (+) strand; PAM type: NRG; PAM sequence: GAG
gtggggaggccgggcgaggg

SEQ ID NO: 12016 - DNA, 20 bp, Artificial Sequence
  Description of Artificial Sequence: Synthetic oligonucleotide
  Target: AGXT; (+) strand; PAM type: NRG; PAM sequence: AGG
tggggaggccgggcgagggg

SEQ ID NO: 12017 - DNA, 20 bp, Artificial Sequence
  Description of Artificial Sequence: Synthetic oligonucleotide
  Target: AGXT; (+) strand; PAM type: NRG; PAM sequence: GGG
ggggaggccgggcgagggga

SEQ ID NO: 12018 - DNA, 20 bp, Artificial Sequence
  Description of Artificial Sequence: Synthetic oligonucleotide
  Target: AGXT; (+) strand; PAM type: NRG; PAM sequence: CAG
gccgggcgaggggagggctg

SEQ ID NO: 12019 - DNA, 20 bp, Artificial Sequence
  Description of Artificial Sequence: Synthetic oligonucleotide
  Target: AGXT; (+) strand; PAM type: NRG; PAM sequence: AGG
ccgggcgaggggagggctgc

SEQ ID NO: 12020 - DNA, 20 bp, Artificial Sequence
  Description of Artificial Sequence: Synthetic oligonucleotide
  Target: AGXT; (+) strand; PAM type: NRG; PAM sequence: CAG
gggagggctgcaggcgtgtg

SEQ ID NO: 12021 - DNA, 20 bp, Artificial Sequence
  Description of Artificial Sequence: Synthetic oligonucleotide
  Target: AGXT; (+) strand; PAM type: NRG; PAM sequence: AGG
ggagggctgcaggcgtgtgc

SEQ ID NO: 12022 - DNA, 20 bp, Artificial Sequence
  Description of Artificial Sequence: Synthetic oligonucleotide
  Target: AGXT; (+) strand; PAM type: NRG; PAM sequence: GGG
gagggctgcaggcgtgtgca

SEQ ID NO: 12023 - DNA, 20 bp, Artificial Sequence
  Description of Artificial Sequence: Synthetic oligonucleotide
  Target: AGXT; (+) strand; PAM type: NRG; PAM sequence: CAG
ctgcaggcgtgtgcagggtg

SEQ ID NO: 12024 - DNA, 20 bp, Artificial Sequence
  Description of Artificial Sequence: Synthetic oligonucleotide
  Target: AGXT; (+) strand; PAM type: NRG; PAM sequence: GAG
gcaggcgtgtgcagggtgca

SEQ ID NO: 12025 - DNA, 20 bp, Artificial Sequence
  Description of Artificial Sequence: Synthetic oligonucleotide
  Target: AGXT; (+) strand; PAM type: NRG; PAM sequence: TGG
gggtgcagagtccactgctc

SEQ ID NO: 12026 - DNA, 20 bp, Artificial Sequence
  Description of Artificial Sequence: Synthetic oligonucleotide
  Target: AGXT; (+) strand; PAM type: NRG; PAM sequence: AAG
tgcagagtccactgctctgg

SEQ ID NO: 12027 - DNA, 20 bp, Artificial Sequence
  Description of Artificial Sequence: Synthetic oligonucleotide
  Target: AGXT; (+) strand; PAM type: NRG; PAM sequence: CAG
tccactgctctggaagttcc

SEQ ID NO: 12028 - DNA, 20 bp, Artificial Sequence
  Description of Artificial Sequence: Synthetic oligonucleotide
  Target: AGXT; (+) strand; PAM type: NRG; PAM sequence: CAG
tctggaagttcccagcttca

SEQ ID NO: 12029 - DNA, 20 bp, Artificial Sequence
  Description of Artificial Sequence: Synthetic oligonucleotide
  Target: AGXT; (+) strand; PAM type: NRG; PAM sequence: AAG
gaagttcccagcttcacagc

SEQ ID NO: 12030 - DNA, 20 bp, Artificial Sequence
  Description of Artificial Sequence: Synthetic oligonucleotide
  Target: AGXT; (+) strand; PAM type: NRG; PAM sequence: AGG
aagttcccagcttcacagca

SEQ ID NO: 12031 - DNA, 20 bp, Artificial Sequence
  Description of Artificial Sequence: Synthetic oligonucleotide
  Target: AGXT; (+) strand; PAM type: NRG; PAM sequence: GAG
gttcccagcttcacagcaag

SEQ ID NO: 12032 - DNA, 20 bp, Artificial Sequence
  Description of Artificial Sequence: Synthetic oligonucleotide
  Target: AGXT; (+) strand; PAM type: NRG; PAM sequence: CAG
gcttcacagcaaggagtgac

SEQ ID NO: 12033 - DNA, 20 bp, Artificial Sequence
  Description of Artificial Sequence: Synthetic oligonucleotide
  Target: AGXT; (+) strand; PAM type: NRG; PAM sequence: AGG
cttcacagcaaggagtgacc

SEQ ID NO: 12034 - DNA, 20 bp, Artificial Sequence
  Description of Artificial Sequence: Synthetic oligonucleotide
  Target: AGXT; (+) strand; PAM type: NRG; PAM sequence: AAG
acagcaaggagtgaccagga

SEQ ID NO: 12035 - DNA, 20 bp, Artificial Sequence
  Description of Artificial Sequence: Synthetic oligonucleotide
  Target: AGXT; (+) strand; PAM type: NRG; PAM sequence: AGG
cagcaaggagtgaccaggaa

SEQ ID NO: 12036 - DNA, 20 bp, Artificial Sequence
  Description of Artificial Sequence: Synthetic oligonucleotide
  Target: AGXT; (+) strand; PAM type: NRG; PAM sequence: GAG
ggagtgaccaggaaaggact

SEQ ID NO: 12037 - DNA, 20 bp, Artificial Sequence
  Description of Artificial Sequence: Synthetic oligonucleotide
  Target: AGXT; (+) strand; PAM type: NRG; PAM sequence: AGG
gagtgaccaggaaaggactg

SEQ ID NO: 12038 - DNA, 20 bp, Artificial Sequence
  Description of Artificial Sequence: Synthetic oligonucleotide
  Target: AGXT; (+) strand; PAM type: NRG; PAM sequence: GGG
agtgaccaggaaaggactga

SEQ ID NO: 12039 - DNA, 20 bp, Artificial Sequence
  Description of Artificial Sequence: Synthetic oligonucleotide
  Target: AGXT; (+) strand; PAM type: NRG; PAM sequence: GAG
caggaaaggactgagggcct

SEQ ID NO: 12040 - DNA, 20 bp, Artificial Sequence
  Description of Artificial Sequence: Synthetic oligonucleotide
  Target: AGXT; (+) strand; PAM type: NRG; PAM sequence: AGG
aggaaaggactgagggcctg

SEQ ID NO: 12041 - DNA, 20 bp, Artificial Sequence
  Description of Artificial Sequence: Synthetic oligonucleotide
  Target: AGXT; (+) strand; PAM type: NRG; PAM sequence: CAG
aggactgagggcctgaggcc

SEQ ID NO: 12042 - DNA, 20 bp, Artificial Sequence
  Description of Artificial Sequence: Synthetic oligonucleotide
  Target: AGXT; (+) strand; PAM type: NRG; PAM sequence: CGG
ctgaggcccagtgccctgac

SEQ ID NO: 12043 - DNA, 20 bp, Artificial Sequence
  Description of Artificial Sequence: Synthetic oligonucleotide
  Target: AGXT; (+) strand; PAM type: NRG; PAM sequence: TGG
gccctgaccggcctctgccc

SEQ ID NO: 12044 - DNA, 20 bp, Artificial Sequence
  Description of Artificial Sequence: Synthetic oligonucleotide
  Target: AGXT; (+) strand; PAM type: NRG; PAM sequence: CAG
gaccggcctctgccctggct

SEQ ID NO: 12045 - DNA, 20 bp, Artificial Sequence
  Description of Artificial Sequence: Synthetic oligonucleotide
  Target: AGXT; (+) strand; PAM type: NRG; PAM sequence: CAG
ctctgccctggctcagcttc

SEQ ID NO: 12046 - DNA, 20 bp, Artificial Sequence
  Description of Artificial Sequence: Synthetic oligonucleotide
  Target: AGXT; (+) strand; PAM type: NRG; PAM sequence: AGG
tctgccctggctcagcttcc

SEQ ID NO: 12047 - DNA, 20 bp, Artificial Sequence
  Description of Artificial Sequence: Synthetic oligonucleotide
  Target: AGXT; (+) strand; PAM type: NRG; PAM sequence: GGG
ctgccctggctcagcttcca

SEQ ID NO: 12048 - DNA, 20 bp, Artificial Sequence
  Description of Artificial Sequence: Synthetic oligonucleotide
  Target: AGXT; (+) strand; PAM type: NRG; PAM sequence: GGG
tgccctggctcagcttccag

SEQ ID NO: 12049 - DNA, 20 bp, Artificial Sequence
  Description of Artificial Sequence: Synthetic oligonucleotide
  Target: AGXT; (+) strand; PAM type: NRG; PAM sequence: AAG
cagcttccaggggctgcccc

SEQ ID NO: 12050 - DNA, 20 bp, Artificial Sequence
  Description of Artificial Sequence: Synthetic oligonucleotide
  Target: AGXT; (+) strand; PAM type: NRG; PAM sequence: AGG
agcttccaggggctgcccca

SEQ ID NO: 12051 - DNA, 20 bp, Artificial Sequence
  Description of Artificial Sequence: Synthetic oligonucleotide
  Target: AGXT; (+) strand; PAM type: NRG; PAM sequence: GGG
gcttccaggggctgccccaa

SEQ ID NO: 12052 - DNA, 20 bp, Artificial Sequence
  Description of Artificial Sequence: Synthetic oligonucleotide
  Target: AGXT; (+) strand; PAM type: NRG; PAM sequence: TGG
ggctgccccaagggacaacg

SEQ ID NO: 12053 - DNA, 20 bp, Artificial Sequence
  Description of Artificial Sequence: Synthetic oligonucleotide
  Target: AGXT; (+) strand; PAM type: NRG; PAM sequence: GGG
gctgccccaagggacaacgt

SEQ ID NO: 12054 - DNA, 20 bp, Artificial Sequence
  Description of Artificial Sequence: Synthetic oligonucleotide
  Target: AGXT; (+) strand; PAM type: NRG; PAM sequence: CAG
gggacaacgtgggccacaca

SEQ ID NO: 12055 - DNA, 20 bp, Artificial Sequence
  Description of Artificial Sequence: Synthetic oligonucleotide
  Target: AGXT; (+) strand; PAM type: NRG; PAM sequence: CAG
gccacacacagtgccccctg

SEQ ID NO: 12056 - DNA, 20 bp, Artificial Sequence
  Description of Artificial Sequence: Synthetic oligonucleotide
  Target: AGXT; (+) strand; PAM type: NRG; PAM sequence: TGG
ccaatctcacctcccgctcc

SEQ ID NO: 12057 - DNA, 20 bp, Artificial Sequence
  Description of Artificial Sequence: Synthetic oligonucleotide
  Target: AGXT; (+) strand; PAM type: NRG; PAM sequence: CAG
cacctcccgctcctggtgtc

SEQ ID NO: 12058 - DNA, 20 bp, Artificial Sequence
  Description of Artificial Sequence: Synthetic oligonucleotide
  Target: AGXT; (+) strand; PAM type: NRG; PAM sequence: GAG
gctcctggtgtccagattct

SEQ ID NO: 12059 - DNA, 20 bp, Artificial Sequence
  Description of Artificial Sequence: Synthetic oligonucleotide
  Target: AGXT; (+) strand; PAM type: NRG; PAM sequence: CAG
ctggtgtccagattctgagc

SEQ ID NO: 12060 - DNA, 20 bp, Artificial Sequence
  Description of Artificial Sequence: Synthetic oligonucleotide
  Target: AGXT; (+) strand; PAM type: NRG; PAM sequence: AGG
tggtgtccagattctgagcc

SEQ ID NO: 12061 - DNA, 20 bp, Artificial Sequence
  Description of Artificial Sequence: Synthetic oligonucleotide
  Target: AGXT; (+) strand; PAM type: NRG; PAM sequence: CGG
gtccagattctgagccaggc

SEQ ID NO: 12062 - DNA, 20 bp, Artificial Sequence
  Description of Artificial Sequence: Synthetic oligonucleotide
  Target: AGXT; (+) strand; PAM type: NRG; PAM sequence: GGG
tccagattctgagccaggcc

SEQ ID NO: 12063 - DNA, 20 bp, Artificial Sequence
  Description of Artificial Sequence: Synthetic oligonucleotide
  Target: AGXT; (+) strand; PAM type: NRG; PAM sequence: CAG
agattctgagccaggccggg

SEQ ID NO: 12064 - DNA, 20 bp, Artificial Sequence
  Description of Artificial Sequence: Synthetic oligonucleotide
  Target: AGXT; (+) strand; PAM type: NRG; PAM sequence: AGG
gattctgagccaggccgggc

SEQ ID NO: 12065 - DNA, 20 bp, Artificial Sequence
  Description of Artificial Sequence: Synthetic oligonucleotide
  Target: AGXT; (+) strand; PAM type: NRG; PAM sequence: GGG
attctgagccaggccgggca

SEQ ID NO: 12066 - DNA, 20 bp, Artificial Sequence
  Description of Artificial Sequence: Synthetic oligonucleotide
  Target: AGXT; (+) strand; PAM type: NRG; PAM sequence: GGG
ttctgagccaggccgggcag

SEQ ID NO: 12067 - DNA, 20 bp, Artificial Sequence
  Description of Artificial Sequence: Synthetic oligonucleotide
  Target: AGXT; (+) strand; PAM type: NRG; PAM sequence: GGG
tctgagccaggccgggcagg

SEQ ID NO: 12068 - DNA, 20 bp, Artificial Sequence
  Description of Artificial Sequence: Synthetic oligonucleotide
  Target: AGXT; (+) strand; PAM type: NRG; PAM sequence: TAG
gagccaggccgggcaggggg

SEQ ID NO: 12069 - DNA, 20 bp, Artificial Sequence
  Description of Artificial Sequence: Synthetic oligonucleotide
  Target: AGXT; (+) strand; PAM type: NRG; PAM sequence: AGG
agccaggccgggcagggggt

SEQ ID NO: 12070 - DNA, 20 bp, Artificial Sequence
  Description of Artificial Sequence: Synthetic oligonucleotide
  Target: AGXT; (+) strand; PAM type: NRG; PAM sequence: GGG
gccaggccgggcagggggta

SEQ ID NO: 12071 - DNA, 20 bp, Artificial Sequence
  Description of Artificial Sequence: Synthetic oligonucleotide
  Target: AGXT; (+) strand; PAM type: NRG; PAM sequence: GGG
ccaggccgggcagggggtag

SEQ ID NO: 12072 - DNA, 20 bp, Artificial Sequence
  Description of Artificial Sequence: Synthetic oligonucleotide
  Target: AGXT; (+) strand; PAM type: NRG; PAM sequence: AAG
ggccgggcagggggtagggg

SEQ ID NO: 12073 - DNA, 20 bp, Artificial Sequence
  Description of Artificial Sequence: Synthetic oligonucleotide
  Target: AGXT; (+) strand; PAM type: NRG; PAM sequence: AGG
gccgggcagggggtagggga

SEQ ID NO: 12074 - DNA, 20 bp, Artificial Sequence
  Description of Artificial Sequence: Synthetic oligonucleotide
  Target: AGXT; (+) strand; PAM type: NRG; PAM sequence: GGG
ccgggcagggggtaggggaa

SEQ ID NO: 12075 - DNA, 20 bp, Artificial Sequence
  Description of Artificial Sequence: Synthetic oligonucleotide
  Target: AGXT; (+) strand; PAM type: NRG; PAM sequence: GGG
cgggcagggggtaggggaag

SEQ ID NO: 12076 - DNA, 20 bp, Artificial Sequence
  Description of Artificial Sequence: Synthetic oligonucleotide
  Target: AGXT; (+) strand; PAM type: NRG; PAM sequence: GGG
gggcagggggtaggggaagg

SEQ ID NO: 12077 - DNA, 20 bp, Artificial Sequence
  Description of Artificial Sequence: Synthetic oligonucleotide
  Target: AGXT; (+) strand; PAM type: NRG; PAM sequence: CAG
agggggtaggggaagggggc

SEQ ID NO: 12078 - DNA, 20 bp, Artificial Sequence
  Description of Artificial Sequence: Synthetic oligonucleotide
  Target: AGXT; (+) strand; PAM type: NRG; PAM sequence: CAG
gggaagggggccagacctca

SEQ ID NO: 12079 - DNA, 20 bp, Artificial Sequence
  Description of Artificial Sequence: Synthetic oligonucleotide
  Target: AGXT; (+) strand; PAM type: NRG; PAM sequence: AGG
ggaagggggccagacctcac

SEQ ID NO: 12080 - DNA, 20 bp, Artificial Sequence
  Description of Artificial Sequence: Synthetic oligonucleotide
  Target: AGXT; (+) strand; PAM type: NRG; PAM sequence: CGG
agggggccagacctcacagg

SEQ ID NO: 12081 - DNA, 20 bp, Artificial Sequence
  Description of Artificial Sequence: Synthetic oligonucleotide
  Target: AGXT; (+) strand; PAM type: NRG; PAM sequence: CAG
cctcacaggcggttcccatc

SEQ ID NO: 12082 - DNA, 20 bp, Artificial Sequence
  Description of Artificial Sequence: Synthetic oligonucleotide
  Target: AGXT; (+) strand; PAM type: NRG; PAM sequence: CAG
aggcggttcccatccagctg

SEQ ID NO: 12083 - DNA, 20 bp, Artificial Sequence
  Description of Artificial Sequence: Synthetic oligonucleotide
  Target: AGXT; (+) strand; PAM type: NRG; PAM sequence: TGG
gttcccatccagctgcagcc

SEQ ID NO: 12084 - DNA, 20 bp, Artificial Sequence
  Description of Artificial Sequence: Synthetic oligonucleotide
  Target: AGXT; (+) strand; PAM type: NRG; PAM sequence: TGG
tccagctgcagcctggcaac

SEQ ID NO: 12085 - DNA, 20 bp, Artificial Sequence
  Description of Artificial Sequence: Synthetic oligonucleotide
  Target: AGXT; (+) strand; PAM type: NRG; PAM sequence: GAG
cagctgcagcctggcaactg

SEQ ID NO: 12086 - DNA, 20 bp, Artificial Sequence
  Description of Artificial Sequence: Synthetic oligonucleotide
  Target: AGXT; (+) strand; PAM type: NRG; PAM sequence: AGG
agctgcagcctggcaactgg

SEQ ID NO: 12087 - DNA, 20 bp, Artificial Sequence
  Description of Artificial Sequence: Synthetic oligonucleotide
  Target: AGXT; (+) strand; PAM type: NRG; PAM sequence: CAG
caactggaggtgccgttccc

SEQ ID NO: 12088 - DNA, 20 bp, Artificial Sequence
  Description of Artificial Sequence: Synthetic oligonucleotide
  Target: AGXT; (+) strand; PAM type: NRG; PAM sequence: CAG
ggaggtgccgttccccagaa

SEQ ID NO: 12089 - DNA, 20 bp, Artificial Sequence
  Description of Artificial Sequence: Synthetic oligonucleotide
  Target: AGXT; (+) strand; PAM type: NRG; PAM sequence: GAG
aggtgccgttccccagaaca

SEQ ID NO: 12090 - DNA, 20 bp, Artificial Sequence
  Description of Artificial Sequence: Synthetic oligonucleotide
  Target: AGXT; (+) strand; PAM type: NRG; PAM sequence: GAG
gtgccgttccccagaacaga

SEQ ID NO: 12091 - DNA, 20 bp, Artificial Sequence
  Description of Artificial Sequence: Synthetic oligonucleotide
  Target: AGXT; (+) strand; PAM type: NRG; PAM sequence: AGG
tgccgttccccagaacagag

SEQ ID NO: 12092 - DNA, 20 bp, Artificial Sequence
  Description of Artificial Sequence: Synthetic oligonucleotide
  Target: AGXT; (+) strand; PAM type: NRG; PAM sequence: CGG
ccccagaacagagaggactt

SEQ ID NO: 12093 - DNA, 20 bp, Artificial Sequence
  Description of Artificial Sequence: Synthetic oligonucleotide
  Target: AGXT; (+) strand; PAM type: NRG; PAM sequence: GGG
cccagaacagagaggacttc

SEQ ID NO: 12094 - DNA, 20 bp, Artificial Sequence
  Description of Artificial Sequence: Synthetic oligonucleotide
  Target: AGXT; (+) strand; PAM type: NRG; PAM sequence: GGG
ccagaacagagaggacttcg

SEQ ID NO: 12095 - DNA, 20 bp, Artificial Sequence
  Description of Artificial Sequence: Synthetic oligonucleotide
  Target: AGXT; (+) strand; PAM type: NRG; PAM sequence: GAG
agaacagagaggacttcggg

SEQ ID NO: 12096 - DNA, 20 bp, Artificial Sequence
  Description of Artificial Sequence: Synthetic oligonucleotide
  Target: AGXT; (+) strand; PAM type: NRG; PAM sequence: AAG
acagagaggacttcggggag

SEQ ID NO: 12097 - DNA, 20 bp, Artificial Sequence
  Description of Artificial Sequence: Synthetic oligonucleotide
  Target: AGXT; (+) strand; PAM type: NRG; PAM sequence: CAG
agaggacttcggggagaagt

SEQ ID NO: 12098 - DNA, 20 bp, Artificial Sequence
  Description of Artificial Sequence: Synthetic oligonucleotide
  Target: AGXT; (+) strand; PAM type: NRG; PAM sequence: AGG
gaggacttcggggagaagtc

SEQ ID NO: 12099 - DNA, 20 bp, Artificial Sequence
  Description of Artificial Sequence: Synthetic oligonucleotide
  Target: AGXT; (+) strand; PAM type: NRG; PAM sequence: CGG
tcggggagaagtcaggaatt

SEQ ID NO: 12100 - DNA, 20 bp, Artificial Sequence
  Description of Artificial Sequence: Synthetic oligonucleotide
  Target: AGXT; (+) strand; PAM type: NRG; PAM sequence: TGG
agaagtcaggaattcggtgt

SEQ ID NO: 12101 - DNA, 20 bp, Artificial Sequence
  Description of Artificial Sequence: Synthetic oligonucleotide
  Target: AGXT; (+) strand; PAM type: NRG; PAM sequence: TGG
caggaattcggtgttggacg

SEQ ID NO: 12102 - DNA, 20 bp, Artificial Sequence
  Description of Artificial Sequence: Synthetic oligonucleotide
  Target: AGXT; (+) strand; PAM type: NRG; PAM sequence: GGG
aggaattcggtgttggacgt

SEQ ID NO: 12103 - DNA, 20 bp, Artificial Sequence
  Description of Artificial Sequence: Synthetic oligonucleotide
  Target: AGXT; (+) strand; PAM type: NRG; PAM sequence: GAG
gaattcggtgttggacgtgg

SEQ ID NO: 12104 - DNA, 20 bp, Artificial Sequence
  Description of Artificial Sequence: Synthetic oligonucleotide
  Target: AGXT; (+) strand; PAM type: NRG; PAM sequence: AGG
aattcggtgttggacgtggg

SEQ ID NO: 12105 - DNA, 20 bp, Artificial Sequence
  Description of Artificial Sequence: Synthetic oligonucleotide
  Target: AGXT; (+) strand; PAM type: NRG; PAM sequence: GAG
gtgttggacgtgggaggtct

SEQ ID NO: 12106 - DNA, 20 bp, Artificial Sequence
  Description of Artificial Sequence: Synthetic oligonucleotide
  Target: AGXT; (+) strand; PAM type: NRG; PAM sequence: CAG
acgtgggaggtctgagatgc

SEQ ID NO: 12107 - DNA, 20 bp, Artificial Sequence
  Description of Artificial Sequence: Synthetic oligonucleotide
  Target: AGXT; (+) strand; PAM type: NRG; PAM sequence: TGG
gggaggtctgagatgccagc

SEQ ID NO: 12108 - DNA, 20 bp, Artificial Sequence
  Description of Artificial Sequence: Synthetic oligonucleotide
  Target: AGXT; (+) strand; PAM type: NRG; PAM sequence: CGG
gagatgccagctggaccaca

SEQ ID NO: 12109 - DNA, 20 bp, Artificial Sequence
  Description of Artificial Sequence: Synthetic oligonucleotide
  Target: AGXT; (+) strand; PAM type: NRG; PAM sequence: GGG
agatgccagctggaccacac

SEQ ID NO: 12110 - DNA, 20 bp, Artificial Sequence
  Description of Artificial Sequence: Synthetic oligonucleotide
  Target: AGXT; (+) strand; PAM type: NRG; PAM sequence: GAG
atgccagctggaccacacgg

SEQ ID NO: 12111 - DNA, 20 bp, Artificial Sequence
  Description of Artificial Sequence: Synthetic oligonucleotide
  Target: AGXT; (+) strand; PAM type: NRG; PAM sequence: AGG
tgccagctggaccacacggg

SEQ ID NO: 12112 - DNA, 20 bp, Artificial Sequence
  Description of Artificial Sequence: Synthetic oligonucleotide
  Target: AGXT; (+) strand; PAM type: NRG; PAM sequence: GGG
gccagctggaccacacggga

SEQ ID NO: 12113 - DNA, 20 bp, Artificial Sequence
  Description of Artificial Sequence: Synthetic oligonucleotide
  Target: AGXT; (+) strand; PAM type: NRG; PAM sequence: AAG
ctggaccacacgggagggtg

SEQ ID NO: 12114 - DNA, 20 bp, Artificial Sequence
  Description of Artificial Sequence: Synthetic oligonucleotide
  Target: AGXT; (+) strand; PAM type: NRG; PAM sequence: AGG
tggaccacacgggagggtga

SEQ ID NO: 12115 - DNA, 20 bp, Artificial Sequence
  Description of Artificial Sequence: Synthetic oligonucleotide
  Target: AGXT; (+) strand; PAM type: NRG; PAM sequence: AAG
accacacgggagggtgaagg

SEQ ID NO: 12116 - DNA, 20 bp, Artificial Sequence
  Description of Artificial Sequence: Synthetic oligonucleotide
  Target: AGXT; (+) strand; PAM type: NRG; PAM sequence: CGG
acacgggagggtgaaggaag

SEQ ID NO: 12117 - DNA, 20 bp, Artificial Sequence
  Description of Artificial Sequence: Synthetic oligonucleotide
  Target: AGXT; (+) strand; PAM type: NRG; PAM sequence: TGG
gggagggtgaaggaagcggc

SEQ ID NO: 12118 - DNA, 20 bp, Artificial Sequence
  Description of Artificial Sequence: Synthetic oligonucleotide
  Target: AGXT; (+) strand; PAM type: NRG; PAM sequence: GGG
ggagggtgaaggaagcggct

SEQ ID NO: 12119 - DNA, 20 bp, Artificial Sequence
  Description of Artificial Sequence: Synthetic oligonucleotide
  Target: AGXT; (+) strand; PAM type: NRG; PAM sequence: GAG
tgaaggaagcggctgggtgt

SEQ ID NO: 12120 - DNA, 20 bp, Artificial Sequence
  Description of Artificial Sequence: Synthetic oligonucleotide
  Target: AGXT; (+) strand; PAM type: NRG; PAM sequence: CAG
ggaagcggctgggtgtgagt

SEQ ID NO: 12121 - DNA, 20 bp, Artificial Sequence
  Description of Artificial Sequence: Synthetic oligonucleotide
  Target: AGXT; (+) strand; PAM type: NRG; PAM sequence: AGG
gaagcggctgggtgtgagtc

SEQ ID NO: 12122 - DNA, 20 bp, Artificial Sequence
  Description of Artificial Sequence: Synthetic oligonucleotide
  Target: AGXT; (+) strand; PAM type: NRG; PAM sequence: GAG
agcggctgggtgtgagtcag

SEQ ID NO: 12123 - DNA, 20 bp, Artificial Sequence
  Description of Artificial Sequence: Synthetic oligonucleotide
  Target: AGXT; (+) strand; PAM type: NRG; PAM sequence: TGG
ctgggtgtgagtcaggagcc

SEQ ID NO: 12124 - DNA, 20 bp, Artificial Sequence
  Description of Artificial Sequence: Synthetic oligonucleotide
  Target: AGXT; (+) strand; PAM type: NRG; PAM sequence: GGG
tgggtgtgagtcaggagcct

SEQ ID NO: 12125 - DNA, 20 bp, Artificial Sequence
  Description of Artificial Sequence: Synthetic oligonucleotide
  Target: AGXT; (+) strand; PAM type: NRG; PAM sequence: GGG
gggtgtgagtcaggagcctg

SEQ ID NO: 12126 - DNA, 20 bp, Artificial Sequence
  Description of Artificial Sequence: Synthetic oligonucleotide
  Target: AGXT; (+) strand; PAM type: NRG; PAM sequence: GAG
gtgtgagtcaggagcctggg

SEQ ID NO: 12127 - DNA, 20 bp, Artificial Sequence
  Description of Artificial Sequence: Synthetic oligonucleotide
  Target: AGXT; (+) strand; PAM type: NRG; PAM sequence: GAG
gtgagtcaggagcctgggga

SEQ ID NO: 12128 - DNA, 20 bp, Artificial Sequence
  Description of Artificial Sequence: Synthetic oligonucleotide
  Target: AGXT; (+) strand; PAM type: NRG; PAM sequence: AGG
tgagtcaggagcctggggag

SEQ ID NO: 12129 - DNA, 20 bp, Artificial Sequence
  Description of Artificial Sequence: Synthetic oligonucleotide
  Target: AGXT; (+) strand; PAM type: NRG; PAM sequence: CGG
tcaggagcctggggagaggc

SEQ ID NO: 12130 - DNA, 20 bp, Artificial Sequence
  Description of Artificial Sequence: Synthetic oligonucleotide
  Target: AGXT; (+) strand; PAM type: NRG; PAM sequence: GGG
caggagcctggggagaggcc

SEQ ID NO: 12131 - DNA, 20 bp, Artificial Sequence
  Description of Artificial Sequence: Synthetic oligonucleotide
  Target: AGXT; (+) strand; PAM type: NRG; PAM sequence: GGG
aggagcctggggagaggccg

SEQ ID NO: 12132 - DNA, 20 bp, Artificial Sequence
  Description of Artificial Sequence: Synthetic oligonucleotide
  Target: AGXT; (+) strand; PAM type: NRG; PAM sequence: TGG
gcctggggagaggccggggc

SEQ ID NO: 12133 - DNA, 20 bp, Artificial Sequence
  Description of Artificial Sequence: Synthetic oligonucleotide
  Target: AGXT; (+) strand; PAM type: NRG; PAM sequence: TGG
ccggggctggcccctccatc

SEQ ID NO: 12134 - DNA, 20 bp, Artificial Sequence
  Description of Artificial Sequence: Synthetic oligonucleotide
  Target: AGXT; (+) strand; PAM type: NRG; PAM sequence: GAG
ggggctggcccctccatctg

SEQ ID NO: 12135 - DNA, 20 bp, Artificial Sequence
  Description of Artificial Sequence: Synthetic oligonucleotide
  Target: AGXT; (+) strand; PAM type: NRG; PAM sequence: TAG
ggcccctccatctggagttg

SEQ ID NO: 12136 - DNA, 20 bp, Artificial Sequence
  Description of Artificial Sequence: Synthetic oligonucleotide
  Target: AGXT; (+) strand; PAM type: NRG; PAM sequence: GAG
cccctccatctggagttgta

SEQ ID NO: 12137 - DNA, 20 bp, Artificial Sequence
  Description of Artificial Sequence: Synthetic oligonucleotide
  Target: AGXT; (+) strand; PAM type: NRG; PAM sequence: CGG
tccatctggagttgtagaga

SEQ ID NO: 12138 - DNA, 20 bp, Artificial Sequence
  Description of Artificial Sequence: Synthetic oligonucleotide
  Target: AGXT; (+) strand; PAM type: NRG; PAM sequence: AAG
tgtagagacggacacattta

SEQ ID NO: 12139 - DNA, 20 bp, Artificial Sequence
  Description of Artificial Sequence: Synthetic oligonucleotide
  Target: AGXT; (+) strand; PAM type: NRG; PAM sequence: AAG
acggacacatttaaagtttc

SEQ ID NO: 12140 - DNA, 20 bp, Artificial Sequence
  Description of Artificial Sequence: Synthetic oligonucleotide
  Target: AGXT; (+) strand; PAM type: NRG; PAM sequence: TGG
cacatttaaagtttcaagcc

SEQ ID NO: 12141 - DNA, 20 bp, Artificial Sequence
  Description of Artificial Sequence: Synthetic oligonucleotide
  Target: AGXT; (+) strand; PAM type: NRG; PAM sequence: CAG
tttaaagtttcaagcctggc

SEQ ID NO: 12142 - DNA, 20 bp, Artificial Sequence
  Description of Artificial Sequence: Synthetic oligonucleotide
  Target: AGXT; (+) strand; PAM type: NRG; PAM sequence: TGG
caagcctggccagtgtcccc

SEQ ID NO: 12143 - DNA, 20 bp, Artificial Sequence
  Description of Artificial Sequence: Synthetic oligonucleotide
  Target: AGXT; (+) strand; PAM type: NRG; PAM sequence: GGG
aagcctggccagtgtcccct

SEQ ID NO: 12144 - DNA, 20 bp, Artificial Sequence
  Description of Artificial Sequence: Synthetic oligonucleotide
  Target: AGXT; (+) strand; PAM type: NRG; PAM sequence: GGG
agcctggccagtgtcccctg

SEQ ID NO: 12145 - DNA, 20 bp, Artificial Sequence
  Description of Artificial Sequence: Synthetic oligonucleotide
  Target: AGXT; (+) strand; PAM type: NRG; PAM sequence: AAG
cagtgtcccctggggcccga

SEQ ID NO: 12146 - DNA, 20 bp, Artificial Sequence
  Description of Artificial Sequence: Synthetic oligonucleotide
  Target: AGXT; (+) strand; PAM type: NRG; PAM sequence: CAG
tgtcccctggggcccgaaag

SEQ ID NO: 12147 - DNA, 20 bp, Artificial Sequence
  Description of Artificial Sequence: Synthetic oligonucleotide
  Target: AGXT; (+) strand; PAM type: NRG; PAM sequence: TGG
ggcccgaaagcagtcacctt

SEQ ID NO: 12148 - DNA, 20 bp, Artificial Sequence
  Description of Artificial Sequence: Synthetic oligonucleotide
  Target: AGXT; (+) strand; PAM type: NRG; PAM sequence: GGG
gcccgaaagcagtcaccttt

SEQ ID NO: 12149 - DNA, 20 bp, Artificial Sequence
  Description of Artificial Sequence: Synthetic oligonucleotide
  Target: AGXT; (+) strand; PAM type: NRG; PAM sequence: GAG
cagtcacctttgggtgatgt

SEQ ID NO: 12150 - DNA, 20 bp, Artificial Sequence
  Description of Artificial Sequence: Synthetic oligonucleotide
  Target: AGXT; (+) strand; PAM type: NRG; PAM sequence: AAG
tttgggtgatgtgagaaatg

SEQ ID NO: 12151 - DNA, 20 bp, Artificial Sequence
  Description of Artificial Sequence: Synthetic oligonucleotide
  Target: AGXT; (+) strand; PAM type: NRG; PAM sequence: AGG
ttgggtgatgtgagaaatga

SEQ ID NO: 12152 - DNA, 20 bp, Artificial Sequence
  Description of Artificial Sequence: Synthetic oligonucleotide
  Target: AGXT; (+) strand; PAM type: NRG; PAM sequence: TAG
agaaatgaaggctgaccctg

SEQ ID NO: 12153 - DNA, 20 bp, Artificial Sequence
  Description of Artificial Sequence: Synthetic oligonucleotide
  Target: AGXT; (+) strand; PAM type: NRG; PAM sequence: AGG
gaaatgaaggctgaccctgt

SEQ ID NO: 12154 - DNA, 20 bp, Artificial Sequence
  Description of Artificial Sequence: Synthetic oligonucleotide
  Target: AGXT; (+) strand; PAM type: NRG; PAM sequence: GAG
aatgaaggctgaccctgtag

SEQ ID NO: 12155 - DNA, 20 bp, Artificial Sequence
  Description of Artificial Sequence: Synthetic oligonucleotide
  Target: AGXT; (+) strand; PAM type: NRG; PAM sequence: AGG
atgaaggctgaccctgtagg

SEQ ID NO: 12156 - DNA, 20 bp, Artificial Sequence
  Description of Artificial Sequence: Synthetic oligonucleotide
  Target: AGXT; (+) strand; PAM type: NRG; PAM sequence: GGG
tgaaggctgaccctgtagga

SEQ ID NO: 12157 - DNA, 20 bp, Artificial Sequence
  Description of Artificial Sequence: Synthetic oligonucleotide
  Target: AGXT; (+) strand; PAM type: NRG; PAM sequence: GGG
gaaggctgaccctgtaggag

SEQ ID NO: 12158 - DNA, 20 bp, Artificial Sequence
  Description of Artificial Sequence: Synthetic oligonucleotide
  Target: AGXT; (+) strand; PAM type: NRG; PAM sequence: TGG
gctgaccctgtaggaggggc

SEQ ID NO: 12159 - DNA, 20 bp, Artificial Sequence
  Description of Artificial Sequence: Synthetic oligonucleotide
  Target: AGXT; (+) strand; PAM type: NRG; PAM sequence: GGG
ctgaccctgtaggaggggct

SEQ ID NO: 12160 - DNA, 20 bp, Artificial Sequence
  Description of Artificial Sequence: Synthetic oligonucleotide
  Target: AGXT; (+) strand; PAM type: NRG; PAM sequence: GGG
tgaccctgtaggaggggctg

SEQ ID NO: 12161 - DNA, 20 bp, Artificial Sequence
  Description of Artificial Sequence: Synthetic oligonucleotide
  Target: AGXT; (+) strand; PAM type: NRG; PAM sequence: GGG
gaccctgtaggaggggctgg

SEQ ID NO: 12162 - DNA, 20 bp, Artificial Sequence
  Description of Artificial Sequence: Synthetic oligonucleotide
  Target: AGXT; (+) strand; PAM type: NRG; PAM sequence: GAG
ccctgtaggaggggctgggg

SEQ ID NO: 12163 - DNA, 20 bp, Artificial Sequence
  Description of Artificial Sequence: Synthetic oligonucleotide
  Target: AGXT; (+) strand; PAM type: NRG; PAM sequence: GAG
ctgtaggaggggctggggga

SEQ ID NO: 12164 - DNA, 20 bp, Artificial Sequence
  Description of Artificial Sequence: Synthetic oligonucleotide
  Target: AGXT; (+) strand; PAM type: NRG; PAM sequence: AAG
aggaggggctgggggagaga

SEQ ID NO: 12165 - DNA, 20 bp, Artificial Sequence
  Description of Artificial Sequence: Synthetic oligonucleotide
  Target: AGXT; (+) strand; PAM type: NRG; PAM sequence: AGG
ggaggggctgggggagagaa

SEQ ID NO: 12166 - DNA, 20 bp, Artificial Sequence
  Description of Artificial Sequence: Synthetic oligonucleotide
  Target: AGXT; (+) strand; PAM type: NRG; PAM sequence: GGG
gaggggctgggggagagaaa

SEQ ID NO: 12167 - DNA, 20 bp, Artificial Sequence
  Description of Artificial Sequence: Synthetic oligonucleotide
  Target: AGXT; (+) strand; PAM type: NRG; PAM sequence: GGG
aggggctgggggagagaaag

SEQ ID NO: 12168 - DNA, 20 bp, Artificial Sequence
  Description of Artificial Sequence: Synthetic oligonucleotide
  Target: AGXT; (+) strand; PAM type: NRG; PAM sequence: CAG
gggggagagaaaggggcaca

SEQ ID NO: 12169 - DNA, 20 bp, Artificial Sequence
  Description of Artificial Sequence: Synthetic oligonucleotide
  Target: AGXT; (+) strand; PAM type: NRG; PAM sequence: GAG
gggagagaaaggggcacaca

SEQ ID NO: 12170 - DNA, 20 bp, Artificial Sequence
  Description of Artificial Sequence: Synthetic oligonucleotide
  Target: AGXT; (+) strand; PAM type: NRG; PAM sequence: TGG
agagaaaggggcacacagag

SEQ ID NO: 12171 - DNA, 20 bp, Artificial Sequence
  Description of Artificial Sequence: Synthetic oligonucleotide
  Target: AGXT; (+) strand; PAM type: NRG; PAM sequence: GAG
agaaaggggcacacagagtg

SEQ ID NO: 12172 - DNA, 20 bp, Artificial Sequence
  Description of Artificial Sequence: Synthetic oligonucleotide
  Target: AGXT; (+) strand; PAM type: NRG; PAM sequence: AGG
gaaaggggcacacagagtgg

SEQ ID NO: 12173 - DNA, 20 bp, Artificial Sequence
  Description of Artificial Sequence: Synthetic oligonucleotide
  Target: AGXT; (+) strand; PAM type: NRG; PAM sequence: GGG
aaaggggcacacagagtgga

SEQ ID NO: 12174 - DNA, 20 bp, Artificial Sequence
  Description of Artificial Sequence: Synthetic oligonucleotide
  Target: AGXT; (+) strand; PAM type: NRG; PAM sequence: GAG
aggggcacacagagtggagg

SEQ ID NO: 12175 - DNA, 20 bp, Artificial Sequence
  Description of Artificial Sequence: Synthetic oligonucleotide
  Target: AGXT; (+) strand; PAM type: NRG; PAM sequence: TGG
gcacacagagtggagggagc

SEQ ID NO: 12176 - DNA, 20 bp, Artificial Sequence
  Description of Artificial Sequence: Synthetic oligonucleotide
  Target: AGXT; (+) strand; PAM type: NRG; PAM sequence: TGG
agagtggagggagctggcct

SEQ ID NO: 12177 - DNA, 20 bp, Artificial Sequence
  Description of Artificial Sequence: Synthetic oligonucleotide
  Target: AGXT; (+) strand; PAM type: NRG; PAM sequence: TGG
agctggccttggtgccccca

SEQ ID NO: 12178 - DNA, 20 bp, Artificial Sequence
  Description of Artificial Sequence: Synthetic oligonucleotide
  Target: AGXT; (+) strand; PAM type: NRG; PAM sequence: CAG
tggccttggtgcccccatgg

SEQ ID NO: 12179 - DNA, 20 bp, Artificial Sequence
  Description of Artificial Sequence: Synthetic oligonucleotide
  Target: AGXT; (+) strand; PAM type: NRG; PAM sequence: AGG
ggccttggtgcccccatggc

SEQ ID NO: 12180 - DNA, 20 bp, Artificial Sequence
  Description of Artificial Sequence: Synthetic oligonucleotide
  Target: AGXT; (+) strand; PAM type: NRG; PAM sequence: GGG
gccttggtgcccccatggca

SEQ ID NO: 12181 - DNA, 20 bp, Artificial Sequence
  Description of Artificial Sequence: Synthetic oligonucleotide
  Target: AGXT; (+) strand; PAM type: NRG; PAM sequence: CAG
gcccccatggcagggtcaca

SEQ ID NO: 12182 - DNA, 20 bp, Artificial Sequence
  Description of Artificial Sequence: Synthetic oligonucleotide
  Target: AGXT; (+) strand; PAM type: NRG; PAM sequence: TGG
ccatggcagggtcacacagc

SEQ ID NO: 12183 - DNA, 20 bp, Artificial Sequence
  Description of Artificial Sequence: Synthetic oligonucleotide
  Target: AGXT; (+) strand; PAM type: NRG; PAM sequence: GGG
catggcagggtcacacagct

SEQ ID NO: 12184 - DNA, 20 bp, Artificial Sequence
  Description of Artificial Sequence: Synthetic oligonucleotide
  Target: AGXT; (+) strand; PAM type: NRG; PAM sequence: AAG
agggtcacacagctgggccc

SEQ ID NO: 12185 - DNA, 20 bp, Artificial Sequence
  Description of Artificial Sequence: Synthetic oligonucleotide
  Target: AGXT; (+) strand; PAM type: NRG; PAM sequence: AGG
gggtcacacagctgggccca

SEQ ID NO: 12186 - DNA, 20 bp, Artificial Sequence
  Description of Artificial Sequence: Synthetic oligonucleotide
  Target: AGXT; (+) strand; PAM type: NRG; PAM sequence: GGG
ggtcacacagctgggcccaa

SEQ ID NO: 12187 - DNA, 20 bp, Artificial Sequence
  Description of Artificial Sequence: Synthetic oligonucleotide
  Target: AGXT; (+) strand; PAM type: NRG; PAM sequence: CAG
acacagctgggcccaagggc

SEQ ID NO: 12188 - DNA, 20 bp, Artificial Sequence
  Description of Artificial Sequence: Synthetic oligonucleotide
  Target: AGXT; (+) strand; PAM type: NRG; PAM sequence: CGG
cagctgggcccaagggccag

SEQ ID NO: 12189 - DNA, 20 bp, Artificial Sequence
  Description of Artificial Sequence: Synthetic oligonucleotide
  Target: AGXT; (+) strand; PAM type: NRG; PAM sequence: GGG
agctgggcccaagggccagc

SEQ ID NO: 12190 - DNA, 20 bp, Artificial Sequence
  Description of Artificial Sequence: Synthetic oligonucleotide
  Target: AGXT; (+) strand; PAM type: NRG; PAM sequence: TGG
ggcccaagggccagcgggac

SEQ ID NO: 12191 - DNA, 20 bp, Artificial Sequence
  Description of Artificial Sequence: Synthetic oligonucleotide
  Target: AGXT; (+) strand; PAM type: NRG; PAM sequence: CAG
caagggccagcgggactgga

SEQ ID NO: 12192 - DNA, 20 bp, Artificial Sequence
  Description of Artificial Sequence: Synthetic oligonucleotide
  Target: AGXT; (+) strand; PAM type: NRG; PAM sequence: GAG
gccagcgggactggacagct

SEQ ID NO: 12193 - DNA, 20 bp, Artificial Sequence
  Description of Artificial Sequence: Synthetic oligonucleotide
  Target: AGXT; (+) strand; PAM type: NRG; PAM sequence: AGG
ccagcgggactggacagctg

SEQ ID NO: 12194 - DNA, 20 bp, Artificial Sequence
  Description of Artificial Sequence: Synthetic oligonucleotide
  Target: AGXT; (+) strand; PAM type: NRG; PAM sequence: GGG
cagcgggactggacagctga

SEQ ID NO: 12195 - DNA, 20 bp, Artificial Sequence
  Description of Artificial Sequence: Synthetic oligonucleotide
  Target: AGXT; (+) strand; PAM type: NRG; PAM sequence: CGG
tgagggacccacgacccacc

SEQ ID NO: 12196 - DNA, 20 bp, Artificial Sequence
  Description of Artificial Sequence: Synthetic oligonucleotide
  Target: AGXT; (+) strand; PAM type: NRG; PAM sequence: TGG
cgacccacccggtcccactc

SEQ ID NO: 12197 - DNA, 20 bp, Artificial Sequence
  Description of Artificial Sequence: Synthetic oligonucleotide
  Target: AGXT; (+) strand; PAM type: NRG; PAM sequence: GAG
ccggtcccactctggcccct

SEQ ID NO: 12198 - DNA, 20 bp, Artificial Sequence
  Description of Artificial Sequence: Synthetic oligonucleotide
  Target: AGXT; (+) strand; PAM type: NRG; PAM sequence: CAG
ctggcccctgagcacaaatg

SEQ ID NO: 12199 - DNA, 20 bp, Artificial Sequence
  Description of Artificial Sequence: Synthetic oligonucleotide
  Target: AGXT; (+) strand; PAM type: NRG; PAM sequence: TGG
cccctgagcacaaatgcagc

SEQ ID NO: 12200 - DNA, 20 bp, Artificial Sequence
  Description of Artificial Sequence: Synthetic oligonucleotide
  Target: AGXT; (+) strand; PAM type: NRG; PAM sequence: GGG
ccctgagcacaaatgcagct

SEQ ID NO: 12201 - DNA, 20 bp, Artificial Sequence
  Description of Artificial Sequence: Synthetic oligonucleotide
  Target: AGXT; (+) strand; PAM type: NRG; PAM sequence: GGG
cctgagcacaaatgcagctg

SEQ ID NO: 12202 - DNA, 20 bp, Artificial Sequence
  Description of Artificial Sequence: Synthetic oligonucleotide
  Target: AGXT; (+) strand; PAM type: NRG; PAM sequence: CGG
gagcacaaatgcagctgggg

SEQ ID NO: 12203 - DNA, 20 bp, Artificial Sequence
  Description of Artificial Sequence: Synthetic oligonucleotide
  Target: AGXT; (+) strand; PAM type: NRG; PAM sequence: GGG
agcacaaatgcagctggggc

SEQ ID NO: 12204 - DNA, 20 bp, Artificial Sequence
  Description of Artificial Sequence: Synthetic oligonucleotide
  Target: AGXT; (+) strand; PAM type: NRG; PAM sequence: TGG
gcagctggggcgggccctcc

SEQ ID NO: 12205 - DNA, 20 bp, Artificial Sequence
  Description of Artificial Sequence: Synthetic oligonucleotide
  Target: AGXT; (+) strand; PAM type: NRG; PAM sequence: GGG
cagctggggcgggccctcct

SEQ ID NO: 12206 - DNA, 20 bp, Artificial Sequence
  Description of Artificial Sequence: Synthetic oligonucleotide
  Target: AGXT; (+) strand; PAM type: NRG; PAM sequence: GGG
agctggggcgggccctcctg

SEQ ID NO: 12207 - DNA, 20 bp, Artificial Sequence
  Description of Artificial Sequence: Synthetic oligonucleotide
  Target: AGXT; (+) strand; PAM type: NRG; PAM sequence: GGG
gctggggcgggccctcctgg

SEQ ID NO: 12208 - DNA, 20 bp, Artificial Sequence
  Description of Artificial Sequence: Synthetic oligonucleotide
  Target: AGXT; (+) strand; PAM type: NRG; PAM sequence: CAG
cccgtctcactcccgtgaaa

SEQ ID NO: 12209 - DNA, 20 bp, Artificial Sequence
  Description of Artificial Sequence: Synthetic oligonucleotide
  Target: AGXT; (+) strand; PAM type: NRG; PAM sequence: AGG
ccgtctcactcccgtgaaac

SEQ ID NO: 12210 - DNA, 20 bp, Artificial Sequence
  Description of Artificial Sequence: Synthetic oligonucleotide
  Target: AGXT; (+) strand; PAM type: NRG; PAM sequence: CAG
ctcactcccgtgaaacagga

SEQ ID NO: 12211 - DNA, 20 bp, Artificial Sequence
  Description of Artificial Sequence: Synthetic oligonucleotide
  Target: AGXT; (+) strand; PAM type: NRG; PAM sequence: CAG
ctcccgtgaaacaggacagc

SEQ ID NO: 12212 - DNA, 20 bp, Artificial Sequence
  Description of Artificial Sequence: Synthetic oligonucleotide
  Target: AGXT; (+) strand; PAM type: NRG; PAM sequence: GAG
cgtgaaacaggacagccagc

SEQ ID NO: 12213 - DNA, 20 bp, Artificial Sequence
  Description of Artificial Sequence: Synthetic oligonucleotide
  Target: AGXT; (+) strand; PAM type: NRG; PAM sequence: TGG
gacagccagcgagactgccc

SEQ ID NO: 12214 - DNA, 20 bp, Artificial Sequence
  Description of Artificial Sequence: Synthetic oligonucleotide
  Target: AGXT; (+) strand; PAM type: NRG; PAM sequence: CAG
agcgagactgccctggcctt

SEQ ID NO: 12215 - DNA, 20 bp, Artificial Sequence
  Description of Artificial Sequence: Synthetic oligonucleotide
  Target: AGXT; (+) strand; PAM type: NRG; PAM sequence: GAG
cctggccttcagcccaaact

SEQ ID NO: 12216 - DNA, 20 bp, Artificial Sequence
  Description of Artificial Sequence: Synthetic oligonucleotide
  Target: AGXT; (+) strand; PAM type: NRG; PAM sequence: GAG
tggccttcagcccaaactga

SEQ ID NO: 12217 - DNA, 20 bp, Artificial Sequence
  Description of Artificial Sequence: Synthetic oligonucleotide
  Target: AGXT; (+) strand; PAM type: NRG; PAM sequence: AGG
ggccttcagcccaaactgag

SEQ ID NO: 12218 - DNA, 20 bp, Artificial Sequence
  Description of Artificial Sequence: Synthetic oligonucleotide
  Target: AGXT; (+) strand; PAM type: NRG; PAM sequence: TGG
ttcagcccaaactgagaggc

SEQ ID NO: 12219 - DNA, 20 bp, Artificial Sequence
  Description of Artificial Sequence: Synthetic oligonucleotide
  Target: AGXT; (+) strand; PAM type: NRG; PAM sequence: CAG
caaactgagaggctggtgct

SEQ ID NO: 12220 - DNA, 20 bp, Artificial Sequence
  Description of Artificial Sequence: Synthetic oligonucleotide
  Target: AGXT; (+) strand; PAM type: NRG; PAM sequence: CAG
tcagcctgcttctttctccc

SEQ ID NO: 12221 - DNA, 20 bp, Artificial Sequence
  Description of Artificial Sequence: Synthetic oligonucleotide
  Target: AGXT; (+) strand; PAM type: NRG; PAM sequence: AAG
cctgcttctttctccccaga

SEQ ID NO: 12222 - DNA, 20 bp, Artificial Sequence
  Description of Artificial Sequence: Synthetic oligonucleotide
  Target: AGXT; (+) strand; PAM type: NRG; PAM sequence: AAG
gcttctttctccccagaaag

SEQ ID NO: 12223 - DNA, 20 bp, Artificial Sequence
  Description of Artificial Sequence: Synthetic oligonucleotide
  Target: AGXT; (+) strand; PAM type: NRG; PAM sequence: AAG
gaaagaagatgtactcccgc

SEQ ID NO: 12224 - DNA, 20 bp, Artificial Sequence
  Description of Artificial Sequence: Synthetic oligonucleotide
  Target: AGXT; (+) strand; PAM type: NRG; PAM sequence: AAG
agatgtactcccgcaagacg

SEQ ID NO: 12225 - DNA, 20 bp, Artificial Sequence
  Description of Artificial Sequence: Synthetic oligonucleotide
  Target: AGXT; (+) strand; PAM type: NRG; PAM sequence: TGG
gaagcccttctccttctacc

SEQ ID NO: 12226 - DNA, 20 bp, Artificial Sequence
  Description of Artificial Sequence: Synthetic oligonucleotide
  Target: AGXT; (+) strand; PAM type: NRG; PAM sequence: AAG
tctccttctacctggacatc

SEQ ID NO: 12227 - DNA, 20 bp, Artificial Sequence
  Description of Artificial Sequence: Synthetic oligonucleotide
  Target: AGXT; (+) strand; PAM type: NRG; PAM sequence: TGG
ccttctacctggacatcaag

SEQ ID NO: 12228 - DNA, 20 bp, Artificial Sequence
  Description of Artificial Sequence: Synthetic oligonucleotide
  Target: AGXT; (+) strand; PAM type: NRG; PAM sequence: TGG
ctacctggacatcaagtggc

SEQ ID NO: 12229 - DNA, 20 bp, Artificial Sequence
  Description of Artificial Sequence: Synthetic oligonucleotide
  Target: AGXT; (+) strand; PAM type: NRG; PAM sequence: TGG
tcaagtggctggccaacttc

SEQ ID NO: 12230 - DNA, 20 bp, Artificial Sequence
  Description of Artificial Sequence: Synthetic oligonucleotide
  Target: AGXT; (+) strand; PAM type: NRG; PAM sequence: GGG
caagtggctggccaacttct

SEQ ID NO: 12231 - DNA, 20 bp, Artificial Sequence
  Description of Artificial Sequence: Synthetic oligonucleotide
  Target: AGXT; (+) strand; PAM type: NRG; PAM sequence: GGG
aagtggctggccaacttctg

SEQ ID NO: 12232 - DNA, 20 bp, Artificial Sequence
  Description of Artificial Sequence: Synthetic oligonucleotide
  Target: AGXT; (+) strand; PAM type: NRG; PAM sequence: CAG
acttctggggctgtgacgac

SEQ ID NO: 12233 - DNA, 20 bp, Artificial Sequence
  Description of Artificial Sequence: Synthetic oligonucleotide
  Target: AGXT; (+) strand; PAM type: NRG; PAM sequence: CAG
tggggctgtgacgaccagcc

SEQ ID NO: 12234 - DNA, 20 bp, Artificial Sequence
  Description of Artificial Sequence: Synthetic oligonucleotide
  Target: AGXT; (+) strand; PAM type: NRG; PAM sequence: AGG
ggggctgtgacgaccagccc

SEQ ID NO: 12235 - DNA, 20 bp, Artificial Sequence
  Description of Artificial Sequence: Synthetic oligonucleotide
  Target: AGXT; (+) strand; PAM type: NRG; PAM sequence: GAG
tgacgaccagcccaggatgt

SEQ ID NO: 12236 - DNA, 20 bp, Artificial Sequence
  Description of Artificial Sequence: Synthetic oligonucleotide
  Target: AGXT; (+) strand; PAM type: NRG; PAM sequence: AGG
gacgaccagcccaggatgtg

SEQ ID NO: 12237 - DNA, 20 bp, Artificial Sequence
  Description of Artificial Sequence: Synthetic oligonucleotide
  Target: AGXT; (+) strand; PAM type: NRG; PAM sequence: TGG
ccagcccaggatgtgaggcc

SEQ ID NO: 12238 - DNA, 20 bp, Artificial Sequence
  Description of Artificial Sequence: Synthetic oligonucleotide
  Target: AGXT; (+) strand; PAM type: NRG; PAM sequence: CAG
gcccaggatgtgaggcctgg

SEQ ID NO: 12239 - DNA, 20 bp, Artificial Sequence
  Description of Artificial Sequence: Synthetic oligonucleotide
  Target: AGXT; (+) strand; PAM type: NRG; PAM sequence: AGG
cccaggatgtgaggcctggc

SEQ ID NO: 12240 - DNA, 20 bp, Artificial Sequence
  Description of Artificial Sequence: Synthetic oligonucleotide
  Target: AGXT; (+) strand; PAM type: NRG; PAM sequence: GGG
ccaggatgtgaggcctggca

SEQ ID NO: 12241 - DNA, 20 bp, Artificial Sequence
  Description of Artificial Sequence: Synthetic oligonucleotide
  Target: AGXT; (+) strand; PAM type: NRG; PAM sequence: TGG
gatgtgaggcctggcaggga

SEQ ID NO: 12242 - DNA, 20 bp, Artificial Sequence
  Description of Artificial Sequence: Synthetic oligonucleotide
  Target: AGXT; (+) strand; PAM type: NRG; PAM sequence: GGG
atgtgaggcctggcagggat

SEQ ID NO: 12243 - DNA, 20 bp, Artificial Sequence
  Description of Artificial Sequence: Synthetic oligonucleotide
  Target: AGXT; (+) strand; PAM type: NRG; PAM sequence: AAG
tgaggcctggcagggatggg

SEQ ID NO: 12244 - DNA, 20 bp, Artificial Sequence
  Description of Artificial Sequence: Synthetic oligonucleotide
  Target: AGXT; (+) strand; PAM type: NRG; PAM sequence: AGG
gaggcctggcagggatggga

SEQ ID NO: 12245 - DNA, 20 bp, Artificial Sequence
  Description of Artificial Sequence: Synthetic oligonucleotide
  Target: AGXT; (+) strand; PAM type: NRG; PAM sequence: TGG
gcctggcagggatgggaagg

SEQ ID NO: 12246 - DNA, 20 bp, Artificial Sequence
  Description of Artificial Sequence: Synthetic oligonucleotide
  Target: AGXT; (+) strand; PAM type: NRG; PAM sequence: GAG
ctggcagggatgggaaggtg

SEQ ID NO: 12247 - DNA, 20 bp, Artificial Sequence
  Description of Artificial Sequence: Synthetic oligonucleotide
  Target: AGXT; (+) strand; PAM type: NRG; PAM sequence: AGG
tggcagggatgggaaggtgg

SEQ ID NO: 12248 - DNA, 20 bp, Artificial Sequence
  Description of Artificial Sequence: Synthetic oligonucleotide
  Target: AGXT; (+) strand; PAM type: NRG; PAM sequence: GGG
ggcagggatgggaaggtgga

SEQ ID NO: 12249 - DNA, 20 bp, Artificial Sequence
  Description of Artificial Sequence: Synthetic oligonucleotide
  Target: AGXT; (+) strand; PAM type: NRG; PAM sequence: TGG
gatgggaaggtggagggcgc

SEQ ID NO: 12250 - DNA, 20 bp, Artificial Sequence
  Description of Artificial Sequence: Synthetic oligonucleotide
  Target: AGXT; (+) strand; PAM type: NRG; PAM sequence: GGG
atgggaaggtggagggcgct

SEQ ID NO: 12251 - DNA, 20 bp, Artificial Sequence
  Description of Artificial Sequence: Synthetic oligonucleotide
  Target: AGXT; (+) strand; PAM type: NRG; PAM sequence: TGG
aaggtggagggcgctgggca

SEQ ID NO: 12252 - DNA, 20 bp, Artificial Sequence
  Description of Artificial Sequence: Synthetic oligonucleotide
  Target: AGXT; (+) strand; PAM type: NRG; PAM sequence: GAG
ggagggcgctgggcatggct

SEQ ID NO: 12253 - DNA, 20 bp, Artificial Sequence
  Description of Artificial Sequence: Synthetic oligonucleotide
  Target: AGXT; (+) strand; PAM type: NRG; PAM sequence: GAG
agggcgctgggcatggctga

SEQ ID NO: 12254 - DNA, 20 bp, Artificial Sequence
  Description of Artificial Sequence: Synthetic oligonucleotide
  Target: AGXT; (+) strand; PAM type: NRG; PAM sequence: AGG
gggcgctgggcatggctgag

SEQ ID NO: 12255 - DNA, 20 bp, Artificial Sequence
  Description of Artificial Sequence: Synthetic oligonucleotide
  Target: AGXT; (+) strand; PAM type: NRG; PAM sequence: TGG
cgctgggcatggctgagagg

SEQ ID NO: 12256 - DNA, 20 bp, Artificial Sequence
  Description of Artificial Sequence: Synthetic oligonucleotide
  Target: AGXT; (+) strand; PAM type: NRG; PAM sequence: GGG
gctgggcatggctgagaggt

SEQ ID NO: 12257 - DNA, 20 bp, Artificial Sequence
  Description of Artificial Sequence: Synthetic oligonucleotide
  Target: AGXT; (+) strand; PAM type: NRG; PAM sequence: GGG
ctgggcatggctgagaggtg

SEQ ID NO: 12258 - DNA, 20 bp, Artificial Sequence
  Description of Artificial Sequence: Synthetic oligonucleotide
  Target: AGXT; (+) strand; PAM type: NRG; PAM sequence: TGG
atggctgagaggtggggcgc

SEQ ID NO: 12259 - DNA, 20 bp, Artificial Sequence
  Description of Artificial Sequence: Synthetic oligonucleotide
  Target: AGXT; (+) strand; PAM type: NRG; PAM sequence: CAG
cgctggcctctcactgcact

SEQ ID NO: 12260 - DNA, 20 bp, Artificial Sequence
  Description of Artificial Sequence: Synthetic oligonucleotide
  Target: AGXT; (+) strand; PAM type: NRG; PAM sequence: AGG
gctggcctctcactgcactc

SEQ ID NO: 12261 - DNA, 20 bp, Artificial Sequence
  Description of Artificial Sequence: Synthetic oligonucleotide
  Target: AGXT; (+) strand; PAM type: NRG; PAM sequence: GGG
ctggcctctcactgcactca

SEQ ID NO: 12262 - DNA, 20 bp, Artificial Sequence
  Description of Artificial Sequence: Synthetic oligonucleotide
  Target: AGXT; (+) strand; PAM type: NRG; PAM sequence: AAG
actgcactcagggattctcc

SEQ ID NO: 12263 - DNA, 20 bp, Artificial Sequence
  Description of Artificial Sequence: Synthetic oligonucleotide
  Target: AGXT; (+) strand; PAM type: NRG; PAM sequence: AAG
gccccccaccttcatgcctc

SEQ ID NO: 12264 - DNA, 20 bp, Artificial Sequence
  Description of Artificial Sequence: Synthetic oligonucleotide
  Target: AGXT; (+) strand; PAM type: NRG; PAM sequence: TAG
catgcctcaagaaccccaac

SEQ ID NO: 12265 - DNA, 20 bp, Artificial Sequence
  Description of Artificial Sequence: Synthetic oligonucleotide
  Target: AGXT; (+) strand; PAM type: NRG; PAM sequence: GAG
tgcctcaagaaccccaacta

SEQ ID NO: 12266 - DNA, 20 bp, Artificial Sequence
  Description of Artificial Sequence: Synthetic oligonucleotide
  Target: AGXT; (+) strand; PAM type: NRG; PAM sequence: CAG
aagaaccccaactagagccc

SEQ ID NO: 12267 - DNA, 20 bp, Artificial Sequence
  Description of Artificial Sequence: Synthetic oligonucleotide
  Target: AGXT; (+) strand; PAM type: NRG; PAM sequence: CAG
gccccagaatccgcctgcat

SEQ ID NO: 12268 - DNA, 20 bp, Artificial Sequence
  Description of Artificial Sequence: Synthetic oligonucleotide
  Target: AGXT; (+) strand; PAM type: NRG; PAM sequence: AGG
ccccagaatccgcctgcatc

SEQ ID NO: 12269 - DNA, 20 bp, Artificial Sequence
  Description of Artificial Sequence: Synthetic oligonucleotide
  Target: AGXT; (+) strand; PAM type: NRG; PAM sequence: CAG
cagaatccgcctgcatcagg

SEQ ID NO: 12270 - DNA, 20 bp, Artificial Sequence
  Description of Artificial Sequence: Synthetic oligonucleotide
  Target: AGXT; (+) strand; PAM type: NRG; PAM sequence: TGG
ggcagtcaaatgccccaccc

SEQ ID NO: 12271 - DNA, 20 bp, Artificial Sequence
  Description of Artificial Sequence: Synthetic oligonucleotide
  Target: AGXT; (+) strand; PAM type: NRG; PAM sequence: GGG
gcagtcaaatgccccaccct

SEQ ID NO: 12272 - DNA, 20 bp, Artificial Sequence
  Description of Artificial Sequence: Synthetic oligonucleotide
  Target: AGXT; (+) strand; PAM type: NRG; PAM sequence: TGG
gggttcccccattcctcgac

SEQ ID NO: 12273 - DNA, 20 bp, Artificial Sequence
  Description of Artificial Sequence: Synthetic oligonucleotide
  Target: AGXT; (+) strand; PAM type: NRG; PAM sequence: GAG
ccccattcctcgactggccc

SEQ ID NO: 12274 - DNA, 20 bp, Artificial Sequence
  Description of Artificial Sequence: Synthetic oligonucleotide
  Target: AGXT; (+) strand; PAM type: NRG; PAM sequence: AGG
cccattcctcgactggcccg

SEQ ID NO: 12275 - DNA, 20 bp, Artificial Sequence
  Description of Artificial Sequence: Synthetic oligonucleotide
  Target: AGXT; (+) strand; PAM type: NRG; PAM sequence: TGG
cctcgactggcccgaggctc

SEQ ID NO: 12276 - DNA, 20 bp, Artificial Sequence
  Description of Artificial Sequence: Synthetic oligonucleotide
  Target: AGXT; (+) strand; PAM type: NRG; PAM sequence: GGG
ctcgactggcccgaggctct

SEQ ID NO: 12277 - DNA, 20 bp, Artificial Sequence
  Description of Artificial Sequence: Synthetic oligonucleotide
  Target: AGXT; (+) strand; PAM type: NRG; PAM sequence: CAG
gactggcccgaggctctggg

SEQ ID NO: 12278 - DNA, 20 bp, Artificial Sequence
  Description of Artificial Sequence: Synthetic oligonucleotide
  Target: AGXT; (+) strand; PAM type: NRG; PAM sequence: AGG
actggcccgaggctctgggc

SEQ ID NO: 12279 - DNA, 20 bp, Artificial Sequence
  Description of Artificial Sequence: Synthetic oligonucleotide
  Target: AGXT; (+) strand; PAM type: NRG; PAM sequence: GGG
ctggcccgaggctctgggca

SEQ ID NO: 12280 - DNA, 20 bp, Artificial Sequence
  Description of Artificial Sequence: Synthetic oligonucleotide
  Target: AGXT; (+) strand; PAM type: NRG; PAM sequence: TGG
cgaggctctgggcagggtca

SEQ ID NO: 12281 - DNA, 20 bp, Artificial Sequence
  Description of Artificial Sequence: Synthetic oligonucleotide
  Target: AGXT; (+) strand; PAM type: NRG; PAM sequence: CAG
ttccacaaacactgtccccc

SEQ ID NO: 12282 - DNA, 20 bp, Artificial Sequence
  Description of Artificial Sequence: Synthetic oligonucleotide
  Target: AGXT; (+) strand; PAM type: NRG; PAM sequence: GAG
ccacaaacactgtcccccca

SEQ ID NO: 12283 - DNA, 20 bp, Artificial Sequence
  Description of Artificial Sequence: Synthetic oligonucleotide
  Target: AGXT; (+) strand; PAM type: NRG; PAM sequence: AGG
cacaaacactgtccccccag

SEQ ID NO: 12284 - DNA, 20 bp, Artificial Sequence
  Description of Artificial Sequence: Synthetic oligonucleotide
  Target: AGXT; (+) strand; PAM type: NRG; PAM sequence: CAG
cactgtccccccagaggtcc

SEQ ID NO: 12285 - DNA, 20 bp, Artificial Sequence
  Description of Artificial Sequence: Synthetic oligonucleotide
  Target: AGXT; (+) strand; PAM type: NRG; PAM sequence: CGG
cagaggtcccagcacaccct

SEQ ID NO: 12286 - DNA, 20 bp, Artificial Sequence
  Description of Artificial Sequence: Synthetic oligonucleotide
  Target: AGXT; (+) strand; PAM type: NRG; PAM sequence: GGG
agaggtcccagcacaccctc

SEQ ID NO: 12287 - DNA, 20 bp, Artificial Sequence
  Description of Artificial Sequence: Synthetic oligonucleotide
  Target: AGXT; (+) strand; PAM type: NRG; PAM sequence: TGG
cagcacaccctcgggcactt

SEQ ID NO: 12288 - DNA, 20 bp, Artificial Sequence
  Description of Artificial Sequence: Synthetic oligonucleotide
  Target: AGXT; (+) strand; PAM type: NRG; PAM sequence: TGG
accctcgggcactttggacc

SEQ ID NO: 12289 - DNA, 20 bp, Artificial Sequence
  Description of Artificial Sequence: Synthetic oligonucleotide
  Target: AGXT; (+) strand; PAM type: NRG; PAM sequence: TGG
ctgccacatctccccactcc

SEQ ID NO: 12290 - DNA, 20 bp, Artificial Sequence
  Description of Artificial Sequence: Synthetic oligonucleotide
  Target: AGXT; (+) strand; PAM type: NRG; PAM sequence: GGG
tgccacatctccccactcct

SEQ ID NO: 12291 - DNA, 20 bp, Artificial Sequence
  Description of Artificial Sequence: Synthetic oligonucleotide
  Target: AGXT; (+) strand; PAM type: NRG; PAM sequence: CAG
atctccccactcctgggcct

SEQ ID NO: 12292 - DNA, 20 bp, Artificial Sequence
  Description of Artificial Sequence: Synthetic oligonucleotide
  Target: AGXT; (+) strand; PAM type: NRG; PAM sequence: AAG
ctcagcttaccccttctgaa

SEQ ID NO: 12293 - DNA, 20 bp, Artificial Sequence
  Description of Artificial Sequence: Synthetic oligonucleotide
  Target: AGXT; (+) strand; PAM type: NRG; PAM sequence: TGG
cccttctgaaaagacgacct

SEQ ID NO: 12294 - DNA, 20 bp, Artificial Sequence
  Description of Artificial Sequence: Synthetic oligonucleotide
  Target: AGXT; (+) strand; PAM type: NRG; PAM sequence: AAG
acgaccttggccataaaccc

SEQ ID NO: 12295 - DNA, 20 bp, Artificial Sequence
  Description of Artificial Sequence: Synthetic oligonucleotide
  Target: AGXT; (+) strand; PAM type: NRG; PAM sequence: AGG
cgaccttggccataaaccca

SEQ ID NO: 12296 - DNA, 20 bp, Artificial Sequence
  Description of Artificial Sequence: Synthetic oligonucleotide
  Target: AGXT; (+) strand; PAM type: NRG; PAM sequence: CAG
aaggccccttatgttacaca

SEQ ID NO: 12297 - DNA, 20 bp, Artificial Sequence
  Description of Artificial Sequence: Synthetic oligonucleotide
  Target: AGXT; (+) strand; PAM type: NRG; PAM sequence: AGG
aggccccttatgttacacac

SEQ ID NO: 12298 - DNA, 20 bp, Artificial Sequence
  Description of Artificial Sequence: Synthetic oligonucleotide
  Target: AGXT; (+) strand; PAM type: NRG; PAM sequence: AAG
cttatgttacacacaggaac

SEQ ID NO: 12299 - DNA, 20 bp, Artificial Sequence
  Description of Artificial Sequence: Synthetic oligonucleotide
  Target: AGXT; (+) strand; PAM type: NRG; PAM sequence: AGG
ttatgttacacacaggaaca

SEQ ID NO: 12300 - DNA, 20 bp, Artificial Sequence
  Description of Artificial Sequence: Synthetic oligonucleotide
  Target: AGXT; (+) strand; PAM type: NRG; PAM sequence: CAG
tacacacaggaacaaggcgc

SEQ ID NO: 12301 - DNA, 20 bp, Artificial Sequence
  Description of Artificial Sequence: Synthetic oligonucleotide
  Target: AGXT; (+) strand; PAM type: NRG; PAM sequence: AGG
acacacaggaacaaggcgcc

SEQ ID NO: 12302 - DNA, 20 bp, Artificial Sequence
  Description of Artificial Sequence: Synthetic oligonucleotide
  Target: AGXT; (+) strand; PAM type: NRG; PAM sequence: TGG
caggaacaaggcgccaggaa

SEQ ID NO: 12303 - DNA, 20 bp, Artificial Sequence
  Description of Artificial Sequence: Synthetic oligonucleotide
  Target: AGXT; (+) strand; PAM type: NRG; PAM sequence: TAG
aggcgccaggaatggtgccc

SEQ ID NO: 12304 - DNA, 20 bp, Artificial Sequence
  Description of Artificial Sequence: Synthetic oligonucleotide
  Target: AGXT; (+) strand; PAM type: NRG; PAM sequence: CAG
ccaggaatggtgccctagcc

SEQ ID NO: 12305 - DNA, 20 bp, Artificial Sequence
  Description of Artificial Sequence: Synthetic oligonucleotide
  Target: AGXT; (+) strand; PAM type: NRG; PAM sequence: TGG
ggaatggtgccctagcccag

SEQ ID NO: 12306 - DNA, 20 bp, Artificial Sequence
  Description of Artificial Sequence: Synthetic oligonucleotide
  Target: AGXT; (+) strand; PAM type: NRG; PAM sequence: GGG
gaatggtgccctagcccagt

SEQ ID NO: 12307 - DNA, 20 bp, Artificial Sequence
  Description of Artificial Sequence: Synthetic oligonucleotide
  Target: AGXT; (+) strand; PAM type: NRG; PAM sequence: CAG
gtgccctagcccagtgggca

SEQ ID NO: 12308 - DNA, 20 bp, Artificial Sequence
  Description of Artificial Sequence: Synthetic oligonucleotide
  Target: AGXT; (+) strand; PAM type: NRG; PAM sequence: GAG
gccctagcccagtgggcaca

SEQ ID NO: 12309 - DNA, 20 bp, Artificial Sequence
  Description of Artificial Sequence: Synthetic oligonucleotide
  Target: AGXT; (+) strand; PAM type: NRG; PAM sequence: AGG
ccctagcccagtgggcacag

SEQ ID NO: 12310 - DNA, 20 bp, Artificial Sequence
  Description of Artificial Sequence: Synthetic oligonucleotide
  Target: AGXT; (+) strand; PAM type: NRG; PAM sequence: GGG
cctagcccagtgggcacaga

SEQ ID NO: 12311 - DNA, 20 bp, Artificial Sequence
  Description of Artificial Sequence: Synthetic oligonucleotide
  Target: AGXT; (+) strand; PAM type: NRG; PAM sequence: CAG
gcccagtgggcacagagggc

SEQ ID NO: 12312 - DNA, 20 bp, Artificial Sequence
  Description of Artificial Sequence: Synthetic oligonucleotide
  Target: AGXT; (+) strand; PAM type: NRG; PAM sequence: CGG
tgggcacagagggccagtgc

SEQ ID NO: 12313 - DNA, 20 bp, Artificial Sequence
  Description of Artificial Sequence: Synthetic oligonucleotide
  Target: AGXT; (+) strand; PAM type: NRG; PAM sequence: CAG
gagggccagtgccggcttcg

SEQ ID NO: 12314 - DNA, 20 bp, Artificial Sequence
  Description of Artificial Sequence: Synthetic oligonucleotide
  Target: AGXT; (+) strand; PAM type: NRG; PAM sequence: AGG
agggccagtgccggcttcgc

SEQ ID NO: 12315 - DNA, 20 bp, Artificial Sequence
  Description of Artificial Sequence: Synthetic oligonucleotide
  Target: AGXT; (+) strand; PAM type: NRG; PAM sequence: TGG
tgccggcttcgcaggcacgc

SEQ ID NO: 12316 - DNA, 20 bp, Artificial Sequence
  Description of Artificial Sequence: Synthetic oligonucleotide
  Target: AGXT; (+) strand; PAM type: NRG; PAM sequence: GGG
gccggcttcgcaggcacgct

SEQ ID NO: 12317 - DNA, 20 bp, Artificial Sequence
  Description of Artificial Sequence: Synthetic oligonucleotide
  Target: AGXT; (+) strand; PAM type: NRG; PAM sequence: GAG
ttcgcaggcacgctgggact

SEQ ID NO: 12318 - DNA, 20 bp, Artificial Sequence
  Description of Artificial Sequence: Synthetic oligonucleotide
  Target: AGXT; (+) strand; PAM type: NRG; PAM sequence: AGG
tcgcaggcacgctgggactg

SEQ ID NO: 12319 - DNA, 20 bp, Artificial Sequence
  Description of Artificial Sequence: Synthetic oligonucleotide
  Target: AGXT; (+) strand; PAM type: NRG; PAM sequence: GGG
cgcaggcacgctgggactga

SEQ ID NO: 12320 - DNA, 20 bp, Artificial Sequence
  Description of Artificial Sequence: Synthetic oligonucleotide
  Target: AGXT; (+) strand; PAM type: NRG; PAM sequence: GGG
gcaggcacgctgggactgag

SEQ ID NO: 12321 - DNA, 20 bp, Artificial Sequence
  Description of Artificial Sequence: Synthetic oligonucleotide
  Target: AGXT; (+) strand; PAM type: NRG; PAM sequence: CAG
gctgggactgaggggctccg

SEQ ID NO: 12322 - DNA, 20 bp, Artificial Sequence
  Description of Artificial Sequence: Synthetic oligonucleotide
  Target: AGXT; (+) strand; PAM type: NRG; PAM sequence: AGG
ctgggactgaggggctccgc

SEQ ID NO: 12323 - DNA, 20 bp, Artificial Sequence
  Description of Artificial Sequence: Synthetic oligonucleotide
  Target: AGXT; (+) strand; PAM type: NRG; PAM sequence: GGG
tgggactgaggggctccgca

SEQ ID NO: 12324 - DNA, 20 bp, Artificial Sequence
  Description of Artificial Sequence: Synthetic oligonucleotide
  Target: AGXT; (+) strand; PAM type: NRG; PAM sequence: GAG
ggactgaggggctccgcagg

SEQ ID NO: 12325 - DNA, 20 bp, Artificial Sequence
  Description of Artificial Sequence: Synthetic oligonucleotide
  Target: AGXT; (+) strand; PAM type: NRG; PAM sequence: AGG
gactgaggggctccgcaggg

SEQ ID NO: 12326 - DNA, 20 bp, Artificial Sequence
  Description of Artificial Sequence: Synthetic oligonucleotide
  Target: AGXT; (+) strand; PAM type: NRG; PAM sequence: TGG
tgaggggctccgcagggagg

SEQ ID NO: 12327 - DNA, 20 bp, Artificial Sequence
  Description of Artificial Sequence: Synthetic oligonucleotide
  Target: AGXT; (+) strand; PAM type: NRG; PAM sequence: TGG
ggggctccgcagggaggtgg

SEQ ID NO: 12328 - DNA, 20 bp, Artificial Sequence
  Description of Artificial Sequence: Synthetic oligonucleotide
  Target: AGXT; (+) strand; PAM type: NRG; PAM sequence: CAG
ggcacgtgtctctgctcctg

SEQ ID NO: 12329 - DNA, 20 bp, Artificial Sequence
  Description of Artificial Sequence: Synthetic oligonucleotide
  Target: AGXT; (+) strand; PAM type: NRG; PAM sequence: TGG
tgcagccacccactgcctcc

SEQ ID NO: 12330 - DNA, 20 bp, Artificial Sequence
  Description of Artificial Sequence: Synthetic oligonucleotide
  Target: AGXT; (+) strand; PAM type: NRG; PAM sequence: TGG
gccacccactgcctcctggc

SEQ ID NO: 12331 - DNA, 20 bp, Artificial Sequence
  Description of Artificial Sequence: Synthetic oligonucleotide
  Target: AGXT; (+) strand; PAM type: NRG; PAM sequence: GGG
ccacccactgcctcctggct

SEQ ID NO: 12332 - DNA, 20 bp, Artificial Sequence
  Description of Artificial Sequence: Synthetic oligonucleotide
  Target: AGXT; (+) strand; PAM type: NRG; PAM sequence: AAG
ctcctggctgggccctacac

SEQ ID NO: 12333 - DNA, 20 bp, Artificial Sequence
  Description of Artificial Sequence: Synthetic oligonucleotide
  Target: AGXT; (+) strand; PAM type: NRG; PAM sequence: TGG
tacacaagccatgctctccc

SEQ ID NO: 12334 - DNA, 20 bp, Artificial Sequence
  Description of Artificial Sequence: Synthetic oligonucleotide
  Target: AGXT; (+) strand; PAM type: NRG; PAM sequence: CAG
acaagccatgctctccctgg

SEQ ID NO: 12335 - DNA, 20 bp, Artificial Sequence
  Description of Artificial Sequence: Synthetic oligonucleotide
  Target: AGXT; (+) strand; PAM type: NRG; PAM sequence: AAG
catgctctccctggcagacg

SEQ ID NO: 12336 - DNA, 20 bp, Artificial Sequence
  Description of Artificial Sequence: Synthetic oligonucleotide
  Target: AGXT; (+) strand; PAM type: NRG; PAM sequence: CGG
ggcagacgaagctgccttcc

SEQ ID NO: 12337 - DNA, 20 bp, Artificial Sequence
  Description of Artificial Sequence: Synthetic oligonucleotide
  Target: AGXT; (+) strand; PAM type: NRG; PAM sequence: AAG
gaagctgccttcccggtcca

SEQ ID NO: 12338 - DNA, 20 bp, Artificial Sequence
  Description of Artificial Sequence: Synthetic oligonucleotide
  Target: AGXT; (+) strand; PAM type: NRG; PAM sequence: CGG
ccggtccaaagttctgaacc

SEQ ID NO: 12339 - DNA, 20 bp, Artificial Sequence
  Description of Artificial Sequence: Synthetic oligonucleotide
  Target: AGXT; (+) strand; PAM type: NRG; PAM sequence: CAG
tccaaagttctgaacccgga

SEQ ID NO: 12340 - DNA, 20 bp, Artificial Sequence
  Description of Artificial Sequence: Synthetic oligonucleotide
  Target: AGXT; (+) strand; PAM type: NRG; PAM sequence: AGG
ccaaagttctgaacccggac

SEQ ID NO: 12341 - DNA, 20 bp, Artificial Sequence
  Description of Artificial Sequence: Synthetic oligonucleotide
  Target: AGXT; (+) strand; PAM type: NRG; PAM sequence: CGG
acccggacaggactcctctg

SEQ ID NO: 12342 - DNA, 20 bp, Artificial Sequence
  Description of Artificial Sequence: Synthetic oligonucleotide
  Target: AGXT; (+) strand; PAM type: NRG; PAM sequence: GAG
ccggacaggactcctctgcg

SEQ ID NO: 12343 - DNA, 20 bp, Artificial Sequence
  Description of Artificial Sequence: Synthetic oligonucleotide
  Target: AGXT; (+) strand; PAM type: NRG; PAM sequence: AGG
cggacaggactcctctgcgg

SEQ ID NO: 12344 - DNA, 20 bp, Artificial Sequence
  Description of Artificial Sequence: Synthetic oligonucleotide
  Target: AGXT; (+) strand; PAM type: NRG; PAM sequence: CGG
gactcctctgcggaggatac

SEQ ID NO: 12345 - DNA, 20 bp, Artificial Sequence
  Description of Artificial Sequence: Synthetic oligonucleotide
  Target: AGXT; (+) strand; PAM type: NRG; PAM sequence: TGG
ctgcggaggataccggcctg

SEQ ID NO: 12346 - DNA, 20 bp, Artificial Sequence
  Description of Artificial Sequence: Synthetic oligonucleotide
  Target: AGXT; (+) strand; PAM type: NRG; PAM sequence: CAG
ggaggataccggcctgtggt

SEQ ID NO: 12347 - DNA, 20 bp, Artificial Sequence
  Description of Artificial Sequence: Synthetic oligonucleotide
  Target: AGXT; (+) strand; PAM type: NRG; PAM sequence: GAG
aggataccggcctgtggtca

SEQ ID NO: 12348 - DNA, 20 bp, Artificial Sequence
  Description of Artificial Sequence: Synthetic oligonucleotide
  Target: AGXT; (+) strand; PAM type: NRG; PAM sequence: GAG
gataccggcctgtggtcaga

SEQ ID NO: 12349 - DNA, 20 bp, Artificial Sequence
  Description of Artificial Sequence: Synthetic oligonucleotide
  Target: AGXT; (+) strand; PAM type: NRG; PAM sequence: TGG
ggtcagagagcctgtgctgt

SEQ ID NO: 12350 - DNA, 20 bp, Artificial Sequence
  Description of Artificial Sequence: Synthetic oligonucleotide
  Target: AGXT; (+) strand; PAM type: NRG; PAM sequence: GGG
gtcagagagcctgtgctgtt

SEQ ID NO: 12351 - DNA, 20 bp, Artificial Sequence
  Description of Artificial Sequence: Synthetic oligonucleotide
  Target: AGXT; (+) strand; PAM type: NRG; PAM sequence: GGG
tcagagagcctgtgctgttg

SEQ ID NO: 12352 - DNA, 20 bp, Artificial Sequence
  Description of Artificial Sequence: Synthetic oligonucleotide
  Target: AGXT; (+) strand; PAM type: NRG; PAM sequence: TGG
agagcctgtgctgttggggc

SEQ ID NO: 12353 - DNA, 20 bp, Artificial Sequence
  Description of Artificial Sequence: Synthetic oligonucleotide
  Target: AGXT; (+) strand; PAM type: NRG; PAM sequence: GGG
gagcctgtgctgttggggct

SEQ ID NO: 12354 - DNA, 20 bp, Artificial Sequence
  Description of Artificial Sequence: Synthetic oligonucleotide
  Target: AGXT; (+) strand; PAM type: NRG; PAM sequence: GGG
agcctgtgctgttggggctg

SEQ ID NO: 12355 - DNA, 20 bp, Artificial Sequence
  Description of Artificial Sequence: Synthetic oligonucleotide
  Target: AGXT; (+) strand; PAM type: NRG; PAM sequence: CAG
ctgtgctgttggggctgggg

SEQ ID NO: 12356 - DNA, 20 bp, Artificial Sequence
  Description of Artificial Sequence: Synthetic oligonucleotide
  Target: AGXT; (+) strand; PAM type: NRG; PAM sequence: CAG
gctgttggggctggggcaga

SEQ ID NO: 12357 - DNA, 20 bp, Artificial Sequence
  Description of Artificial Sequence: Synthetic oligonucleotide
  Target: AGXT; (+) strand; PAM type: NRG; PAM sequence: GAG
tgttggggctggggcagaca

SEQ ID NO: 12358 - DNA, 20 bp, Artificial Sequence
  Description of Artificial Sequence: Synthetic oligonucleotide
  Target: AGXT; (+) strand; PAM type: NRG; PAM sequence: TGG
tctgcccccaaccctgccca

SEQ ID NO: 12359 - DNA, 20 bp, Artificial Sequence
  Description of Artificial Sequence: Synthetic oligonucleotide
  Target: AGXT; (+) strand; PAM type: NRG; PAM sequence: TGG
cccaaccctgcccatggtgc

SEQ ID NO: 12360 - DNA, 20 bp, Artificial Sequence
  Description of Artificial Sequence: Synthetic oligonucleotide
  Target: AGXT; (+) strand; PAM type: NRG; PAM sequence: AAG
cctgcccatggtgctggacc

SEQ ID NO: 12361 - DNA, 20 bp, Artificial Sequence
  Description of Artificial Sequence: Synthetic oligonucleotide
  Target: AGXT; (+) strand; PAM type: NRG; PAM sequence: CAG
ccaagccccctcgtgtcttc

SEQ ID NO: 12362 - DNA, 20 bp, Artificial Sequence
  Description of Artificial Sequence: Synthetic oligonucleotide
  Target: AGXT; (+) strand; PAM type: NRG; PAM sequence: AGG
caagccccctcgtgtcttcc

SEQ ID NO: 12363 - DNA, 20 bp, Artificial Sequence
  Description of Artificial Sequence: Synthetic oligonucleotide
  Target: AGXT; (+) strand; PAM type: NRG; PAM sequence: CAG
catcacacaatccccgtcat

SEQ ID NO: 12364 - DNA, 20 bp, Artificial Sequence
  Description of Artificial Sequence: Synthetic oligonucleotide
  Target: AGXT; (+) strand; PAM type: NRG; PAM sequence: CAG
atccccgtcatcagcctgta

SEQ ID NO: 12365 - DNA, 20 bp, Artificial Sequence
  Description of Artificial Sequence: Synthetic oligonucleotide
  Target: AGXT; (+) strand; PAM type: NRG; PAM sequence: GAG
gtcatcagcctgtacagcct

SEQ ID NO: 12366 - DNA, 20 bp, Artificial Sequence
  Description of Artificial Sequence: Synthetic oligonucleotide
  Target: AGXT; (+) strand; PAM type: NRG; PAM sequence: GAG
catcagcctgtacagcctga

SEQ ID NO: 12367 - DNA, 20 bp, Artificial Sequence
  Description of Artificial Sequence: Synthetic oligonucleotide
  Target: AGXT; (+) strand; PAM type: NRG; PAM sequence: GAG
tcagcctgtacagcctgaga

SEQ ID NO: 12368 - DNA, 20 bp, Artificial Sequence
  Description of Artificial Sequence: Synthetic oligonucleotide
  Target: AGXT; (+) strand; PAM type: NRG; PAM sequence: GAG
agcctgtacagcctgagaga

SEQ ID NO: 12369 - DNA, 20 bp, Artificial Sequence
  Description of Artificial Sequence: Synthetic oligonucleotide
  Target: AGXT; (+) strand; PAM type: NRG; PAM sequence: TGG
gtacagcctgagagagagcc

SEQ ID NO: 12370 - DNA, 20 bp, Artificial Sequence
  Description of Artificial Sequence: Synthetic oligonucleotide
  Target: AGXT; (+) strand; PAM type: NRG; PAM sequence: CGG
agagagcctggccctcattg

SEQ ID NO: 12371 - DNA, 20 bp, Artificial Sequence
  Description of Artificial Sequence: Synthetic oligonucleotide
  Target: AGXT; (+) strand; PAM type: NRG; PAM sequence: CAG
gcctggccctcattgcggaa

SEQ ID NO: 12372 - DNA, 20 bp, Artificial Sequence
  Description of Artificial Sequence: Synthetic oligonucleotide
  Target: AGXT; (+) strand; PAM type: NRG; PAM sequence: AGG
cctggccctcattgcggaac

SEQ ID NO: 12373 - DNA, 20 bp, Artificial Sequence
  Description of Artificial Sequence: Synthetic oligonucleotide
  Target: AGXT; (+) strand; PAM type: NRG; PAM sequence: TGG
ctcattgcggaacaggtgca

SEQ ID NO: 12374 - DNA, 20 bp, Artificial Sequence
  Description of Artificial Sequence: Synthetic oligonucleotide
  Target: AGXT; (+) strand; PAM type: NRG; PAM sequence: GGG
tcattgcggaacaggtgcat

SEQ ID NO: 12375 - DNA, 20 bp, Artificial Sequence
  Description of Artificial Sequence: Synthetic oligonucleotide
  Target: AGXT; (+) strand; PAM type: NRG; PAM sequence: CAG
ggtgcatgggctgcactcca

SEQ ID NO: 12376 - DNA, 20 bp, Artificial Sequence
  Description of Artificial Sequence: Synthetic oligonucleotide
  Target: AGXT; (+) strand; PAM type: NRG; PAM sequence: AGG
gtgcatgggctgcactccac

SEQ ID NO: 12377 - DNA, 20 bp, Artificial Sequence
  Description of Artificial Sequence: Synthetic oligonucleotide
  Target: AGXT; (+) strand; PAM type: NRG; PAM sequence: GAG
gcatgggctgcactccacag

SEQ ID NO: 12378 - DNA, 20 bp, Artificial Sequence
  Description of Artificial Sequence: Synthetic oligonucleotide
  Target: AGXT; (+) strand; PAM type: NRG; PAM sequence: AGG
catgggctgcactccacagg

SEQ ID NO: 12379 - DNA, 20 bp, Artificial Sequence
  Description of Artificial Sequence: Synthetic oligonucleotide
  Target: AGXT; (+) strand; PAM type: NRG; PAM sequence: GAG
tgggctgcactccacaggag

SEQ ID NO: 12380 - DNA, 20 bp, Artificial Sequence
  Description of Artificial Sequence: Synthetic oligonucleotide
  Target: AGXT; (+) strand; PAM type: NRG; PAM sequence: CAG
ctgcactccacaggaggaga

SEQ ID NO: 12381 - DNA, 20 bp, Artificial Sequence
  Description of Artificial Sequence: Synthetic oligonucleotide
  Target: AGXT; (+) strand; PAM type: NRG; PAM sequence: AGG
tgcactccacaggaggagac

SEQ ID NO: 12382 - DNA, 20 bp, Artificial Sequence
  Description of Artificial Sequence: Synthetic oligonucleotide
  Target: AGXT; (+) strand; PAM type: NRG; PAM sequence: GGG
gcactccacaggaggagaca

SEQ ID NO: 12383 - DNA, 20 bp, Artificial Sequence
  Description of Artificial Sequence: Synthetic oligonucleotide
  Target: AGXT; (+) strand; PAM type: NRG; PAM sequence: TGG
acaggaggagacagggccac

SEQ ID NO: 12384 - DNA, 20 bp, Artificial Sequence
  Description of Artificial Sequence: Synthetic oligonucleotide
  Target: AGXT; (+) strand; PAM type: NRG; PAM sequence: TGG
gaggagacagggccactggc

SEQ ID NO: 12385 - DNA, 20 bp, Artificial Sequence
  Description of Artificial Sequence: Synthetic oligonucleotide
  Target: AGXT; (+) strand; PAM type: NRG; PAM sequence: GAG
gggccactggctggattgtc

SEQ ID NO: 12386 - DNA, 20 bp, Artificial Sequence
  Description of Artificial Sequence: Synthetic oligonucleotide
  Target: AGXT; (+) strand; PAM type: NRG; PAM sequence: AGG
ggccactggctggattgtcg

SEQ ID NO: 12387 - DNA, 20 bp, Artificial Sequence
  Description of Artificial Sequence: Synthetic oligonucleotide
  Target: AGXT; (+) strand; PAM type: NRG; PAM sequence: GGG
gccactggctggattgtcga

SEQ ID NO: 12388 - DNA, 20 bp, Artificial Sequence
  Description of Artificial Sequence: Synthetic oligonucleotide
  Target: AGXT; (+) strand; PAM type: NRG; PAM sequence: CGG
tggctggattgtcgagggcg

SEQ ID NO: 12389 - DNA, 20 bp, Artificial Sequence
  Description of Artificial Sequence: Synthetic oligonucleotide
  Target: AGXT; (+) strand; PAM type: NRG; PAM sequence: CAG
attgtcgagggcgcggcctg

SEQ ID NO: 12390 - DNA, 20 bp, Artificial Sequence
  Description of Artificial Sequence: Synthetic oligonucleotide
  Target: AGXT; (+) strand; PAM type: NRG; PAM sequence: GAG
tgtcgagggcgcggcctgca

SEQ ID NO: 12391 - DNA, 20 bp, Artificial Sequence
  Description of Artificial Sequence: Synthetic oligonucleotide
  Target: AGXT; (+) strand; PAM type: NRG; PAM sequence: AAG
cgagggcgcggcctgcagag

SEQ ID NO: 12392 - DNA, 20 bp, Artificial Sequence
  Description of Artificial Sequence: Synthetic oligonucleotide
  Target: AGXT; (+) strand; PAM type: NRG; PAM sequence: AGG
gagggcgcggcctgcagaga

SEQ ID NO: 12393 - DNA, 20 bp, Artificial Sequence
  Description of Artificial Sequence: Synthetic oligonucleotide
  Target: AGXT; (+) strand; PAM type: NRG; PAM sequence: TGG
tgcagagaaggaaccatccc

SEQ ID NO: 12394 - DNA, 20 bp, Artificial Sequence
  Description of Artificial Sequence: Synthetic oligonucleotide
  Target: AGXT; (+) strand; PAM type: NRG; PAM sequence: CAG
aaggaaccatccctggtgca

SEQ ID NO: 12395 - DNA, 20 bp, Artificial Sequence
  Description of Artificial Sequence: Synthetic oligonucleotide
  Target: AGXT; (+) strand; PAM type: NRG; PAM sequence: GAG
ggaaccatccctggtgcaca

SEQ ID NO: 12396 - DNA, 20 bp, Artificial Sequence
  Description of Artificial Sequence: Synthetic oligonucleotide
  Target: AGXT; (+) strand; PAM type: NRG; PAM sequence: AAG
catccctggtgcacagagaa

SEQ ID NO: 12397 - DNA, 20 bp, Artificial Sequence
  Description of Artificial Sequence: Synthetic oligonucleotide
  Target: AGXT; (+) strand; PAM type: NRG; PAM sequence: AGG
atccctggtgcacagagaaa

SEQ ID NO: 12398 - DNA, 20 bp, Artificial Sequence
  Description of Artificial Sequence: Synthetic oligonucleotide
  Target: AGXT; (+) strand; PAM type: NRG; PAM sequence: GGG
tccctggtgcacagagaaaa

SEQ ID NO: 12399 - DNA, 20 bp, Artificial Sequence
  Description of Artificial Sequence: Synthetic oligonucleotide
  Target: AGXT; (+) strand; PAM type: NRG; PAM sequence: GAG
cctggtgcacagagaaaagg

SEQ ID NO: 12400 - DNA, 20 bp, Artificial Sequence
  Description of Artificial Sequence: Synthetic oligonucleotide
  Target: AGXT; (+) strand; PAM type: NRG; PAM sequence: CAG
acagagaaaagggagcctgc

SEQ ID NO: 12401 - DNA, 20 bp, Artificial Sequence
  Description of Artificial Sequence: Synthetic oligonucleotide
  Target: AGXT; (+) strand; PAM type: NRG; PAM sequence: GAG
agagaaaagggagcctgcca

SEQ ID NO: 12402 - DNA, 20 bp, Artificial Sequence
  Description of Artificial Sequence: Synthetic oligonucleotide
  Target: AGXT; (+) strand; PAM type: NRG; PAM sequence: GAG
agaaaagggagcctgccaga

SEQ ID NO: 12403 - DNA, 20 bp, Artificial Sequence
  Description of Artificial Sequence: Synthetic oligonucleotide
  Target: AGXT; (+) strand; PAM type: NRG; PAM sequence: GAG
aaaagggagcctgccagaga

SEQ ID NO: 12404 - DNA, 20 bp, Artificial Sequence
  Description of Artificial Sequence: Synthetic oligonucleotide
  Target: AGXT; (+) strand; PAM type: NRG; PAM sequence: AGG
aaagggagcctgccagagag

SEQ ID NO: 12405 - DNA, 20 bp, Artificial Sequence
  Description of Artificial Sequence: Synthetic oligonucleotide
  Target: AGXT; (+) strand; PAM type: NRG; PAM sequence: CAG
gcctgccagagagaggccct

SEQ ID NO: 12406 - DNA, 20 bp, Artificial Sequence
  Description of Artificial Sequence: Synthetic oligonucleotide
  Target: AGXT; (+) strand; PAM type: NRG; PAM sequence: TGG
tgccagagagaggccctcag

SEQ ID NO: 12407 - DNA, 20 bp, Artificial Sequence
  Description of Artificial Sequence: Synthetic oligonucleotide
  Target: AGXT; (+) strand; PAM type: NRG; PAM sequence: GGG
gccagagagaggccctcagt

SEQ ID NO: 12408 - DNA, 20 bp, Artificial Sequence
  Description of Artificial Sequence: Synthetic oligonucleotide
  Target: AGXT; (+) strand; PAM type: NRG; PAM sequence: GGG
ccagagagaggccctcagtg

SEQ ID NO: 12409 - DNA, 20 bp, Artificial Sequence
  Description of Artificial Sequence: Synthetic oligonucleotide
  Target: AGXT; (+) strand; PAM type: NRG; PAM sequence: GGG
cagagagaggccctcagtgg

SEQ ID NO: 12410 - DNA, 20 bp, Artificial Sequence
  Description of Artificial Sequence: Synthetic oligonucleotide
  Target: AGXT; (+) strand; PAM type: NRG; PAM sequence: TGG
agagaggccctcagtggggg

SEQ ID NO: 12411 - DNA, 20 bp, Artificial Sequence
  Description of Artificial Sequence: Synthetic oligonucleotide
  Target: AGXT; (+) strand; PAM type: NRG; PAM sequence: GGG
gagaggccctcagtgggggt

SEQ ID NO: 12412 - DNA, 20 bp, Artificial Sequence
  Description of Artificial Sequence: Synthetic oligonucleotide
  Target: AGXT; (+) strand; PAM type: NRG; PAM sequence: GGG
agaggccctcagtgggggtg

SEQ ID NO: 12413 - DNA, 20 bp, Artificial Sequence
  Description of Artificial Sequence: Synthetic oligonucleotide
  Target: AGXT; (+) strand; PAM type: NRG; PAM sequence: GGG
gaggccctcagtgggggtgg

SEQ ID NO: 12414 - DNA, 20 bp, Artificial Sequence
  Description of Artificial Sequence: Synthetic oligonucleotide
  Target: AGXT; (+) strand; PAM type: NRG; PAM sequence: GAG
ggccctcagtgggggtgggg

SEQ ID NO: 12415 - DNA, 20 bp, Artificial Sequence
  Description of Artificial Sequence: Synthetic oligonucleotide
  Target: AGXT; (+) strand; PAM type: NRG; PAM sequence: GAG
ccctcagtgggggtggggga

SEQ ID NO: 12416 - DNA, 20 bp, Artificial Sequence
  Description of Artificial Sequence: Synthetic oligonucleotide
  Target: AGXT; (+) strand; PAM type: NRG; PAM sequence: GAG
ctcagtgggggtgggggaga

SEQ ID NO: 12417 - DNA, 20 bp, Artificial Sequence
  Description of Artificial Sequence: Synthetic oligonucleotide
  Target: AGXT; (+) strand; PAM type: NRG; PAM sequence: AGG
tcagtgggggtgggggagag

SEQ ID NO: 12418 - DNA, 20 bp, Artificial Sequence
  Description of Artificial Sequence: Synthetic oligonucleotide
  Target: AGXT; (+) strand; PAM type: NRG; PAM sequence: CAG
tgggggtgggggagagagga

SEQ ID NO: 12419 - DNA, 20 bp, Artificial Sequence
  Description of Artificial Sequence: Synthetic oligonucleotide
  Target: AGXT; (+) strand; PAM type: NRG; PAM sequence: AGG
gggggtgggggagagaggac

SEQ ID NO: 12420 - DNA, 20 bp, Artificial Sequence
  Description of Artificial Sequence: Synthetic oligonucleotide
  Target: AGXT; (+) strand; PAM type: NRG; PAM sequence: GGG
ggggtgggggagagaggaca

SEQ ID NO: 12421 - DNA, 20 bp, Artificial Sequence
  Description of Artificial Sequence: Synthetic oligonucleotide
  Target: AGXT; (+) strand; PAM type: NRG; PAM sequence: CGG
ggggagagaggacagggccc

SEQ ID NO: 12422 - DNA, 20 bp, Artificial Sequence
  Description of Artificial Sequence: Synthetic oligonucleotide
  Target: AGXT; (+) strand; PAM type: NRG; PAM sequence: GGG
gggagagaggacagggcccc

SEQ ID NO: 12423 - DNA, 20 bp, Artificial Sequence
  Description of Artificial Sequence: Synthetic oligonucleotide
  Target: AGXT; (+) strand; PAM type: NRG; PAM sequence: TGG
ggacagggccccgggtacac

SEQ ID NO: 12424 - DNA, 20 bp, Artificial Sequence
  Description of Artificial Sequence: Synthetic oligonucleotide
  Target: AGXT; (+) strand; PAM type: NRG; PAM sequence: CGG
ggccccgggtacactggctg

SEQ ID NO: 12425 - DNA, 20 bp, Artificial Sequence
  Description of Artificial Sequence: Synthetic oligonucleotide
  Target: AGXT; (+) strand; PAM type: NRG; PAM sequence: GGG
gccccgggtacactggctgc

SEQ ID NO: 12426 - DNA, 20 bp, Artificial Sequence
  Description of Artificial Sequence: Synthetic oligonucleotide
  Target: AGXT; (+) strand; PAM type: NRG; PAM sequence: CAG
ccgggtacactggctgcggg

SEQ ID NO: 12427 - DNA, 20 bp, Artificial Sequence
  Description of Artificial Sequence: Synthetic oligonucleotide
  Target: AGXT; (+) strand; PAM type: NRG; PAM sequence: AGG
cgggtacactggctgcgggc

SEQ ID NO: 12428 - DNA, 20 bp, Artificial Sequence
  Description of Artificial Sequence: Synthetic oligonucleotide
  Target: AGXT; (+) strand; PAM type: NRG; PAM sequence: GGG
gggtacactggctgcgggca

SEQ ID NO: 12429 - DNA, 20 bp, Artificial Sequence
  Description of Artificial Sequence: Synthetic oligonucleotide
  Target: AGXT; (+) strand; PAM type: NRG; PAM sequence: CAG
acactggctgcgggcagggc

SEQ ID NO: 12430 - DNA, 20 bp, Artificial Sequence
  Description of Artificial Sequence: Synthetic oligonucleotide
  Target: AGXT; (+) strand; PAM type: NRG; PAM sequence: AGG
cactggctgcgggcagggcc

SEQ ID NO: 12431 - DNA, 20 bp, Artificial Sequence
  Description of Artificial Sequence: Synthetic oligonucleotide
  Target: AGXT; (+) strand; PAM type: NRG; PAM sequence: GGG
actggctgcgggcagggcca

SEQ ID NO: 12432 - DNA, 20 bp, Artificial Sequence
  Description of Artificial Sequence: Synthetic oligonucleotide
  Target: AGXT; (+) strand; PAM type: NRG; PAM sequence: GGG
ctggctgcgggcagggccag

SEQ ID NO: 12433 - DNA, 20 bp, Artificial Sequence
  Description of Artificial Sequence: Synthetic oligonucleotide
  Target: AGXT; (+) strand; PAM type: NRG; PAM sequence: GGG
tggctgcgggcagggccagg

SEQ ID NO: 12434 - DNA, 20 bp, Artificial Sequence
  Description of Artificial Sequence: Synthetic oligonucleotide
  Target: AGXT; (+) strand; PAM type: NRG; PAM sequence: CAG
cgggcagggccagggggata

SEQ ID NO: 12435 - DNA, 20 bp, Artificial Sequence
  Description of Artificial Sequence: Synthetic oligonucleotide
  Target: AGXT; (+) strand; PAM type: NRG; PAM sequence: CAG
gggccagggggatacagccc

SEQ ID NO: 12436 - DNA, 20 bp, Artificial Sequence
  Description of Artificial Sequence: Synthetic oligonucleotide
  Target: AGXT; (+) strand; PAM type: NRG; PAM sequence: AGG
ggccagggggatacagcccc

SEQ ID NO: 12437 - DNA, 20 bp, Artificial Sequence
  Description of Artificial Sequence: Synthetic oligonucleotide
  Target: AGXT; (+) strand; PAM type: NRG; PAM sequence: GGG
gccagggggatacagcccca

SEQ ID NO: 12438 - DNA, 20 bp, Artificial Sequence
  Description of Artificial Sequence: Synthetic oligonucleotide
  Target: AGXT; (+) strand; PAM type: NRG; PAM sequence: CAG
gggggatacagccccaggga

SEQ ID NO: 12439 - DNA, 20 bp, Artificial Sequence
  Description of Artificial Sequence: Synthetic oligonucleotide
  Target: AGXT; (+) strand; PAM type: NRG; PAM sequence: CAG
tacagccccagggacagatg

SEQ ID NO: 12440 - DNA, 20 bp, Artificial Sequence
  Description of Artificial Sequence: Synthetic oligonucleotide
  Target: AGXT; (+) strand; PAM type: NRG; PAM sequence: TGG
cccagggacagatgcagcaa

SEQ ID NO: 12441 - DNA, 20 bp, Artificial Sequence
  Description of Artificial Sequence: Synthetic oligonucleotide
  Target: AGXT; (+) strand; PAM type: NRG; PAM sequence: GGG
ccagggacagatgcagcaat

SEQ ID NO: 12442 - DNA, 20 bp, Artificial Sequence
  Description of Artificial Sequence: Synthetic oligonucleotide
  Target: AGXT; (+) strand; PAM type: NRG; PAM sequence: GGG
cagggacagatgcagcaatg

SEQ ID NO: 12443 - DNA, 20 bp, Artificial Sequence
  Description of Artificial Sequence: Synthetic oligonucleotide
  Target: AGXT; (+) strand; PAM type: NRG; PAM sequence: CAG
ggacagatgcagcaatgggg

SEQ ID NO: 12444 - DNA, 20 bp, Artificial Sequence
  Description of Artificial Sequence: Synthetic oligonucleotide
  Target: AGXT; (+) strand; PAM type: NRG; PAM sequence: AGG
gacagatgcagcaatggggc

SEQ ID NO: 12445 - DNA, 20 bp, Artificial Sequence
  Description of Artificial Sequence: Synthetic oligonucleotide
  Target: AGXT; (+) strand; PAM type: NRG; PAM sequence: TGG
atgcagcaatggggcaggtg

SEQ ID NO: 12446 - DNA, 20 bp, Artificial Sequence
  Description of Artificial Sequence: Synthetic oligonucleotide
  Target: AGXT; (+) strand; PAM type: NRG; PAM sequence: AAG
aacccttccattgctgtgtg

SEQ ID NO: 12447 - DNA, 20 bp, Artificial Sequence
  Description of Artificial Sequence: Synthetic oligonucleotide
  Target: AGXT; (+) strand; PAM type: NRG; PAM sequence: CAG
ccttccattgctgtgtgaag

SEQ ID NO: 12448 - DNA, 20 bp, Artificial Sequence
  Description of Artificial Sequence: Synthetic oligonucleotide
  Target: AGXT; (+) strand; PAM type: NRG; PAM sequence: AAG
ccattgctgtgtgaagcagt

SEQ ID NO: 12449 - DNA, 20 bp, Artificial Sequence
  Description of Artificial Sequence: Synthetic oligonucleotide
  Target: AGXT; (+) strand; PAM type: NRG; PAM sequence: GAG
tgctgtgtgaagcagtaagt

SEQ ID NO: 12450 - DNA, 20 bp, Artificial Sequence
  Description of Artificial Sequence: Synthetic oligonucleotide
  Target: AGXT; (+) strand; PAM type: NRG; PAM sequence: AGG
gctgtgtgaagcagtaagtg

SEQ ID NO: 12451 - DNA, 20 bp, Artificial Sequence
  Description of Artificial Sequence: Synthetic oligonucleotide
  Target: AGXT; (+) strand; PAM type: NRG; PAM sequence: CAG
gtgaagcagtaagtgaggcc

SEQ ID NO: 12452 - DNA, 20 bp, Artificial Sequence
  Description of Artificial Sequence: Synthetic oligonucleotide
  Target: AGXT; (+) strand; PAM type: NRG; PAM sequence: GAG
agcagtaagtgaggcccagt

SEQ ID NO: 12453 - DNA, 20 bp, Artificial Sequence
  Description of Artificial Sequence: Synthetic oligonucleotide
  Target: AGXT; (+) strand; PAM type: NRG; PAM sequence: TGG
agtaagtgaggcccagtgag

SEQ ID NO: 12454 - DNA, 20 bp, Artificial Sequence
  Description of Artificial Sequence: Synthetic oligonucleotide
  Target: AGXT; (+) strand; PAM type: NRG; PAM sequence: GGG
gtaagtgaggcccagtgagt

SEQ ID NO: 12455 - DNA, 20 bp, Artificial Sequence
  Description of Artificial Sequence: Synthetic oligonucleotide
  Target: AGXT; (+) strand; PAM type: NRG; PAM sequence: TGG
agtgaggcccagtgagtggg

SEQ ID NO: 12456 - DNA, 20 bp, Artificial Sequence
  Description of Artificial Sequence: Synthetic oligonucleotide
  Target: AGXT; (+) strand; PAM type: NRG; PAM sequence: GGG
gtgaggcccagtgagtgggt

SEQ ID NO: 12457 - DNA, 20 bp, Artificial Sequence
  Description of Artificial Sequence: Synthetic oligonucleotide
  Target: AGXT; (+) strand; PAM type: NRG; PAM sequence: TGG
ggcccagtgagtgggtgggc

SEQ ID NO: 12458 - DNA, 20 bp, Artificial Sequence
  Description of Artificial Sequence: Synthetic oligonucleotide
  Target: AGXT; (+) strand; PAM type: NRG; PAM sequence: GGG
gcccagtgagtgggtgggct

SEQ ID NO: 12459 - DNA, 20 bp, Artificial Sequence
  Description of Artificial Sequence: Synthetic oligonucleotide
  Target: AGXT; (+) strand; PAM type: NRG; PAM sequence: GAG
ccagtgagtgggtgggctgg

SEQ ID NO: 12460 - DNA, 20 bp, Artificial Sequence
  Description of Artificial Sequence: Synthetic oligonucleotide
  Target: AGXT; (+) strand; PAM type: NRG; PAM sequence: AAG
gtgagtgggtgggctgggag

SEQ ID NO: 12461 - DNA, 20 bp, Artificial Sequence
  Description of Artificial Sequence: Synthetic oligonucleotide
  Target: AGXT; (+) strand; PAM type: NRG; PAM sequence: AGG
tgagtgggtgggctgggaga

SEQ ID NO: 12462 - DNA, 20 bp, Artificial Sequence
  Description of Artificial Sequence: Synthetic oligonucleotide
  Target: AGXT; (+) strand; PAM type: NRG; PAM sequence: GGG
gagtgggtgggctgggagaa

SEQ ID NO: 12463 - DNA, 20 bp, Artificial Sequence
  Description of Artificial Sequence: Synthetic oligonucleotide
  Target: AGXT; (+) strand; PAM type: NRG; PAM sequence: GGG
agtgggtgggctgggagaag

SEQ ID NO: 12464 - DNA, 20 bp, Artificial Sequence
  Description of Artificial Sequence: Synthetic oligonucleotide
  Target: AGXT; (+) strand; PAM type: NRG; PAM sequence: GAG
tgggtgggctgggagaaggg

SEQ ID NO: 12465 - DNA, 20 bp, Artificial Sequence
  Description of Artificial Sequence: Synthetic oligonucleotide
  Target: AGXT; (+) strand; PAM type: NRG; PAM sequence: AGG
gggtgggctgggagaagggg

SEQ ID NO: 12466 - DNA, 20 bp, Artificial Sequence
  Description of Artificial Sequence: Synthetic oligonucleotide
  Target: AGXT; (+) strand; PAM type: NRG; PAM sequence: AAG
gctgggagaaggggaggccg

SEQ ID NO: 12467 - DNA, 20 bp, Artificial Sequence
  Description of Artificial Sequence: Synthetic oligonucleotide
  Target: AGXT; (+) strand; PAM type: NRG; PAM sequence: AGG
ctgggagaaggggaggccga

SEQ ID NO: 12468 - DNA, 20 bp, Artificial Sequence
  Description of Artificial Sequence: Synthetic oligonucleotide
  Target: AGXT; (+) strand; PAM type: NRG; PAM sequence: GGG
tgggagaaggggaggccgaa

SEQ ID NO: 12469 - DNA, 20 bp, Artificial Sequence
  Description of Artificial Sequence: Synthetic oligonucleotide
  Target: AGXT; (+) strand; PAM type: NRG; PAM sequence: GGG
gggagaaggggaggccgaag

SEQ ID NO: 12470 - DNA, 20 bp, Artificial Sequence
  Description of Artificial Sequence: Synthetic oligonucleotide
  Target: AGXT; (+) strand; PAM type: NRG; PAM sequence: CAG
gaaggggaggccgaaggggc

SEQ ID NO: 12471 - DNA, 20 bp, Artificial Sequence
  Description of Artificial Sequence: Synthetic oligonucleotide
  Target: AGXT; (+) strand; PAM type: NRG; PAM sequence: GAG
aggggaggccgaaggggcca

SEQ ID NO: 12472 - DNA, 20 bp, Artificial Sequence
  Description of Artificial Sequence: Synthetic oligonucleotide
  Target: AGXT; (+) strand; PAM type: NRG; PAM sequence: CAG
aggggccagagatgtgccca

SEQ ID NO: 12473 - DNA, 20 bp, Artificial Sequence
  Description of Artificial Sequence: Synthetic oligonucleotide
  Target: AGXT; (+) strand; PAM type: NRG; PAM sequence: TAG
gccagagatgtgcccacaga

SEQ ID NO: 12474 - DNA, 20 bp, Artificial Sequence
  Description of Artificial Sequence: Synthetic oligonucleotide
  Target: AGXT; (+) strand; PAM type: NRG; PAM sequence: AGG
ccagagatgtgcccacagat

SEQ ID NO: 12475 - DNA, 20 bp, Artificial Sequence
  Description of Artificial Sequence: Synthetic oligonucleotide
  Target: AGXT; (+) strand; PAM type: NRG; PAM sequence: TGG
gagatgtgcccacagatagg

SEQ ID NO: 12476 - DNA, 20 bp, Artificial Sequence
  Description of Artificial Sequence: Synthetic oligonucleotide
  Target: AGXT; (+) strand; PAM type: NRG; PAM sequence: GGG
agatgtgcccacagataggt

SEQ ID NO: 12477 - DNA, 20 bp, Artificial Sequence
  Description of Artificial Sequence: Synthetic oligonucleotide
  Target: AGXT; (+) strand; PAM type: NRG; PAM sequence: TGG
tgcccacagataggtgggcg

SEQ ID NO: 12478 - DNA, 20 bp, Artificial Sequence
  Description of Artificial Sequence: Synthetic oligonucleotide
  Target: AGXT; (+) strand; PAM type: NRG; PAM sequence: AAG
gataggtgggcgtggatgta

SEQ ID NO: 12479 - DNA, 20 bp, Artificial Sequence
  Description of Artificial Sequence: Synthetic oligonucleotide
  Target: AGXT; (+) strand; PAM type: NRG; PAM sequence: GAG
ggtgggcgtggatgtaaagt

SEQ ID NO: 12480 - DNA, 20 bp, Artificial Sequence
  Description of Artificial Sequence: Synthetic oligonucleotide
  Target: AGXT; (+) strand; PAM type: NRG; PAM sequence: AGG
gtgggcgtggatgtaaagtg

SEQ ID NO: 12481 - DNA, 20 bp, Artificial Sequence
  Description of Artificial Sequence: Synthetic oligonucleotide
  Target: AGXT; (+) strand; PAM type: NRG; PAM sequence: GGG
tgggcgtggatgtaaagtga

SEQ ID NO: 12482 - DNA, 20 bp, Artificial Sequence
  Description of Artificial Sequence: Synthetic oligonucleotide
  Target: AGXT; (+) strand; PAM type: NRG; PAM sequence: TGG
cgtggatgtaaagtgagggt

SEQ ID NO: 12483 - DNA, 20 bp, Artificial Sequence
  Description of Artificial Sequence: Synthetic oligonucleotide
  Target: AGXT; (+) strand; PAM type: NRG; PAM sequence: CAG
ggatgtaaagtgagggttgg

SEQ ID NO: 12484 - DNA, 20 bp, Artificial Sequence
  Description of Artificial Sequence: Synthetic oligonucleotide
  Target: AGXT; (+) strand; PAM type: NRG; PAM sequence: CAG
gtgagggttggcagttcctg

SEQ ID NO: 12485 - DNA, 20 bp, Artificial Sequence
  Description of Artificial Sequence: Synthetic oligonucleotide
  Target: AGXT; (+) strand; PAM type: NRG; PAM sequence: AGG
tgagggttggcagttcctgc

SEQ ID NO: 12486 - DNA, 20 bp, Artificial Sequence
  Description of Artificial Sequence: Synthetic oligonucleotide
  Target: AGXT; (+) strand; PAM type: NRG; PAM sequence: CAG
gcagttcctgcaggcttgtc

SEQ ID NO: 12487 - DNA, 20 bp, Artificial Sequence
  Description of Artificial Sequence: Synthetic oligonucleotide
  Target: AGXT; (+) strand; PAM type: NRG; PAM sequence: TGG
gcaggcttgtccagctccta

SEQ ID NO: 12488 - DNA, 20 bp, Artificial Sequence
  Description of Artificial Sequence: Synthetic oligonucleotide
  Target: AGXT; (+) strand; PAM type: NRG; PAM sequence: CAG
ggcttgtccagctcctatgg

SEQ ID NO: 12489 - DNA, 20 bp, Artificial Sequence
  Description of Artificial Sequence: Synthetic oligonucleotide
  Target: AGXT; (+) strand; PAM type: NRG; PAM sequence: AGG
gcttgtccagctcctatggc

SEQ ID NO: 12490 - DNA, 20 bp, Artificial Sequence
  Description of Artificial Sequence: Synthetic oligonucleotide
  Target: AGXT; (+) strand; PAM type: NRG; PAM sequence: GGG
cttgtccagctcctatggca

SEQ ID NO: 12491 - DNA, 20 bp, Artificial Sequence
  Description of Artificial Sequence: Synthetic oligonucleotide
  Target: AGXT; (+) strand; PAM type: NRG; PAM sequence: AAG
tccagctcctatggcagggc

SEQ ID NO: 12492 - DNA, 20 bp, Artificial Sequence
  Description of Artificial Sequence: Synthetic oligonucleotide
  Target: AGXT; (+) strand; PAM type: NRG; PAM sequence: GAG
cagctcctatggcagggcaa

SEQ ID NO: 12493 - DNA, 20 bp, Artificial Sequence
  Description of Artificial Sequence: Synthetic oligonucleotide
  Target: AGXT; (+) strand; PAM type: NRG; PAM sequence: GAG
cctatggcagggcaagagct

SEQ ID NO: 12494 - DNA, 20 bp, Artificial Sequence
  Description of Artificial Sequence: Synthetic oligonucleotide
  Target: AGXT; (+) strand; PAM type: NRG; PAM sequence: GAG
gcagggcaagagctgagcat

SEQ ID NO: 12495 - DNA, 20 bp, Artificial Sequence
  Description of Artificial Sequence: Synthetic oligonucleotide
  Target: AGXT; (+) strand; PAM type: NRG; PAM sequence: TGG
aagagctgagcatgagcact

SEQ ID NO: 12496 - DNA, 20 bp, Artificial Sequence
  Description of Artificial Sequence: Synthetic oligonucleotide
  Target: AGXT; (+) strand; PAM type: NRG; PAM sequence: GGG
agagctgagcatgagcactt

SEQ ID NO: 12497 - DNA, 20 bp, Artificial Sequence
  Description of Artificial Sequence: Synthetic oligonucleotide
  Target: AGXT; (+) strand; PAM type: NRG; PAM sequence: CAG
catgagcacttgggtgtgac

SEQ ID NO: 12498 - DNA, 20 bp, Artificial Sequence
  Description of Artificial Sequence: Synthetic oligonucleotide
  Target: AGXT; (+) strand; PAM type: NRG; PAM sequence: AGG
atgagcacttgggtgtgacc

SEQ ID NO: 12499 - DNA, 20 bp, Artificial Sequence
  Description of Artificial Sequence: Synthetic oligonucleotide
  Target: AGXT; (+) strand; PAM type: NRG; PAM sequence: GGG
tgagcacttgggtgtgacca

SEQ ID NO: 12500 - DNA, 20 bp, Artificial Sequence
  Description of Artificial Sequence: Synthetic oligonucleotide
  Target: AGXT; (+) strand; PAM type: NRG; PAM sequence: GGG
gagcacttgggtgtgaccag

SEQ ID NO: 12501 - DNA, 20 bp, Artificial Sequence
  Description of Artificial Sequence: Synthetic oligonucleotide
  Target: AGXT; (+) strand; PAM type: NRG; PAM sequence: TGG
ggtgtgaccaggggttgatt

SEQ ID NO: 12502 - DNA, 20 bp, Artificial Sequence
  Description of Artificial Sequence: Synthetic oligonucleotide
  Target: AGXT; (+) strand; PAM type: NRG; PAM sequence: CAG
cactgcaacatccacactct

SEQ ID NO: 12503 - DNA, 20 bp, Artificial Sequence
  Description of Artificial Sequence: Synthetic oligonucleotide
  Target: AGXT; (+) strand; PAM type: NRG; PAM sequence: AGG
actgcaacatccacactctc

SEQ ID NO: 12504 - DNA, 20 bp, Artificial Sequence
  Description of Artificial Sequence: Synthetic oligonucleotide
  Target: AGXT; (+) strand; PAM type: NRG; PAM sequence: CAG
cactgcaacatccacactct

SEQ ID NO: 12505 - DNA, 20 bp, Artificial Sequence
  Description of Artificial Sequence: Synthetic oligonucleotide
  Target: AGXT; (+) strand; PAM type: NRG; PAM sequence: AGG
actgcaacatccacactctc

SEQ ID NO: 12506 - DNA, 20 bp, Artificial Sequence
  Description of Artificial Sequence: Synthetic oligonucleotide
  Target: AGXT; (+) strand; PAM type: NRG; PAM sequence: CAG
acatccacactctcaggaca

SEQ ID NO: 12507 - DNA, 20 bp, Artificial Sequence
  Description of Artificial Sequence: Synthetic oligonucleotide
  Target: AGXT; (+) strand; PAM type: NRG; PAM sequence: AGG
catccacactctcaggacac

SEQ ID NO: 12508 - DNA, 20 bp, Artificial Sequence
  Description of Artificial Sequence: Synthetic oligonucleotide
  Target: AGXT; (+) strand; PAM type: NRG; PAM sequence: CGG
ccacactctcaggacacagg

SEQ ID NO: 12509 - DNA, 20 bp, Artificial Sequence
  Description of Artificial Sequence: Synthetic oligonucleotide
  Target: AGXT; (+) strand; PAM type: NRG; PAM sequence: GAG
ctctcaggacacaggcggct

SEQ ID NO: 12510 - DNA, 20 bp, Artificial Sequence
  Description of Artificial Sequence: Synthetic oligonucleotide
  Target: AGXT; (+) strand; PAM type: NRG; PAM sequence: GAG
ctcaggacacaggcggctga

SEQ ID NO: 12511 - DNA, 20 bp, Artificial Sequence
  Description of Artificial Sequence: Synthetic oligonucleotide
  Target: AGXT; (+) strand; PAM type: NRG; PAM sequence: TGG
aggacacaggcggctgagag

SEQ ID NO: 12512 - DNA, 20 bp, Artificial Sequence
  Description of Artificial Sequence: Synthetic oligonucleotide
  Target: AGXT; (+) strand; PAM type: NRG; PAM sequence: CAG
caggcggctgagagtggcct

SEQ ID NO: 12513 - DNA, 20 bp, Artificial Sequence
  Description of Artificial Sequence: Synthetic oligonucleotide
  Target: AGXT; (+) strand; PAM type: NRG; PAM sequence: AGG
aggcggctgagagtggcctc

SEQ ID NO: 12514 - DNA, 20 bp, Artificial Sequence
  Description of Artificial Sequence: Synthetic oligonucleotide
  Target: AGXT; (+) strand; PAM type: NRG; PAM sequence: CAG
gctgagagtggcctcaggcc

SEQ ID NO: 12515 - DNA, 20 bp, Artificial Sequence
  Description of Artificial Sequence: Synthetic oligonucleotide
  Target: AGXT; (+) strand; PAM type: NRG; PAM sequence: CAG
gagagtggcctcaggcccag

SEQ ID NO: 12516 - DNA, 20 bp, Artificial Sequence
  Description of Artificial Sequence: Synthetic oligonucleotide
  Target: AGXT; (+) strand; PAM type: NRG; PAM sequence: CAG
cctcaggcccagcagctctg

SEQ ID NO: 12517 - DNA, 20 bp, Artificial Sequence
  Description of Artificial Sequence: Synthetic oligonucleotide
  Target: AGXT; (+) strand; PAM type: NRG; PAM sequence: AGG
ctcaggcccagcagctctgc

SEQ ID NO: 12518 - DNA, 20 bp, Artificial Sequence
  Description of Artificial Sequence: Synthetic oligonucleotide
  Target: AGXT; (+) strand; PAM type: NRG; PAM sequence: GAG
ccagcagctctgcaggccac

SEQ ID NO: 12519 - DNA, 20 bp, Artificial Sequence
  Description of Artificial Sequence: Synthetic oligonucleotide
  Target: AGXT; (+) strand; PAM type: NRG; PAM sequence: CAG
cagctctgcaggccacgaga

SEQ ID NO: 12520 - DNA, 20 bp, Artificial Sequence
  Description of Artificial Sequence: Synthetic oligonucleotide
  Target: AGXT; (+) strand; PAM type: NRG; PAM sequence: AGG
agctctgcaggccacgagac

SEQ ID NO: 12521 - DNA, 20 bp, Artificial Sequence
  Description of Artificial Sequence: Synthetic oligonucleotide
  Target: AGXT; (+) strand; PAM type: NRG; PAM sequence: AAG
tctgcaggccacgagacagg

SEQ ID NO: 12522 - DNA, 20 bp, Artificial Sequence
  Description of Artificial Sequence: Synthetic oligonucleotide
  Target: AGXT; (+) strand; PAM type: NRG; PAM sequence: TGG
aagtcccacctactttcatc

SEQ ID NO: 12523 - DNA, 20 bp, Artificial Sequence
  Description of Artificial Sequence: Synthetic oligonucleotide
  Target: AGXT; (+) strand; PAM type: NRG; PAM sequence: GGG
agtcccacctactttcatct

SEQ ID NO: 12524 - DNA, 20 bp, Artificial Sequence
  Description of Artificial Sequence: Synthetic oligonucleotide
  Target: AGXT; (+) strand; PAM type: NRG; PAM sequence: CAG
catctgggtcctgtgtccca

SEQ ID NO: 12525 - DNA, 20 bp, Artificial Sequence
  Description of Artificial Sequence: Synthetic oligonucleotide
  Target: AGXT; (+) strand; PAM type: NRG; PAM sequence: AGG
atctgggtcctgtgtcccac

SEQ ID NO: 12526 - DNA, 20 bp, Artificial Sequence
  Description of Artificial Sequence: Synthetic oligonucleotide
  Target: AGXT; (+) strand; PAM type: NRG; PAM sequence: GGG
tctgggtcctgtgtcccaca

SEQ ID NO: 12527 - DNA, 20 bp, Artificial Sequence
  Description of Artificial Sequence: Synthetic oligonucleotide
  Target: AGXT; (+) strand; PAM type: NRG; PAM sequence: CAG
tgtcccacagggcccattgc

SEQ ID NO: 12528 - DNA, 20 bp, Artificial Sequence
  Description of Artificial Sequence: Synthetic oligonucleotide
  Target: AGXT; (+) strand; PAM type: NRG; PAM sequence: CAG
cagggcccattgccagccac

SEQ ID NO: 12529 - DNA, 20 bp, Artificial Sequence
  Description of Artificial Sequence: Synthetic oligonucleotide
  Target: AGXT; (+) strand; PAM type: NRG; PAM sequence: CAG
cccattgccagccaccagtc

SEQ ID NO: 12530 - DNA, 20 bp, Artificial Sequence
  Description of Artificial Sequence: Synthetic oligonucleotide
  Target: AGXT; (+) strand; PAM type: NRG; PAM sequence: GAG
cattgccagccaccagtcca

SEQ ID NO: 12531 - DNA, 20 bp, Artificial Sequence
  Description of Artificial Sequence: Synthetic oligonucleotide
  Target: AGXT; (+) strand; PAM type: NRG; PAM sequence: CAG
ccagccaccagtccagagtc

SEQ ID NO: 12532 - DNA, 20 bp, Artificial Sequence
  Description of Artificial Sequence: Synthetic oligonucleotide
  Target: AGXT; (+) strand; PAM type: NRG; PAM sequence: AGG
cagccaccagtccagagtcc

SEQ ID NO: 12533 - DNA, 20 bp, Artificial Sequence
  Description of Artificial Sequence: Synthetic oligonucleotide
  Target: AGXT; (+) strand; PAM type: NRG; PAM sequence: AAG
ccaccagtccagagtccagg

SEQ ID NO: 12534 - DNA, 20 bp, Artificial Sequence
  Description of Artificial Sequence: Synthetic oligonucleotide
  Target: AGXT; (+) strand; PAM type: NRG; PAM sequence: AGG
caccagtccagagtccagga

SEQ ID NO: 12535 - DNA, 20 bp, Artificial Sequence
  Description of Artificial Sequence: Synthetic oligonucleotide
  Target: AGXT; (+) strand; PAM type: NRG; PAM sequence: CGG
cagagtccaggaaggatccc

SEQ ID NO: 12536 - DNA, 20 bp, Artificial Sequence
  Description of Artificial Sequence: Synthetic oligonucleotide
  Target: AGXT; (+) strand; PAM type: NRG; PAM sequence: GGG
agagtccaggaaggatcccc

SEQ ID NO: 12537 - DNA, 20 bp, Artificial Sequence
  Description of Artificial Sequence: Synthetic oligonucleotide
  Target: AGXT; (+) strand; PAM type: NRG; PAM sequence: CAG
caggaaggatccccgggctg

SEQ ID NO: 12538 - DNA, 20 bp, Artificial Sequence
  Description of Artificial Sequence: Synthetic oligonucleotide
  Target: AGXT; (+) strand; PAM type: NRG; PAM sequence: CAG
aaggatccccgggctgcagc

SEQ ID NO: 12539 - DNA, 20 bp, Artificial Sequence
  Description of Artificial Sequence: Synthetic oligonucleotide
  Target: AGXT; (+) strand; PAM type: NRG; PAM sequence: GAG
ggctgcagccagcttcccat

SEQ ID NO: 12540 - DNA, 20 bp, Artificial Sequence
  Description of Artificial Sequence: Synthetic oligonucleotide
  Target: AGXT; (+) strand; PAM type: NRG; PAM sequence: AGG
gctgcagccagcttcccatg

SEQ ID NO: 12541 - DNA, 20 bp, Artificial Sequence
  Description of Artificial Sequence: Synthetic oligonucleotide
  Target: AGXT; (+) strand; PAM type: NRG; PAM sequence: AAG
ccagcttcccatgaggttgc

SEQ ID NO: 12542 - DNA, 20 bp, Artificial Sequence
  Description of Artificial Sequence: Synthetic oligonucleotide
  Target: AGXT; (+) strand; PAM type: NRG; PAM sequence: AGG
cagcttcccatgaggttgca

SEQ ID NO: 12543 - DNA, 20 bp, Artificial Sequence
  Description of Artificial Sequence: Synthetic oligonucleotide
  Target: AGXT; (+) strand; PAM type: NRG; PAM sequence: TGG
gcctgccacgtttgtcctcc

SEQ ID NO: 12544 - DNA, 20 bp, Artificial Sequence
  Description of Artificial Sequence: Synthetic oligonucleotide
  Target: AGXT; (+) strand; PAM type: NRG; PAM sequence: GGG
cctgccacgtttgtcctcct

SEQ ID NO: 12545 - DNA, 20 bp, Artificial Sequence
  Description of Artificial Sequence: Synthetic oligonucleotide
  Target: AGXT; (+) strand; PAM type: NRG; PAM sequence: AAG
tcctcctgggtccactcata

SEQ ID NO: 12546 - DNA, 20 bp, Artificial Sequence
  Description of Artificial Sequence: Synthetic oligonucleotide
  Target: AGXT; (+) strand; PAM type: NRG; PAM sequence: TAG
ccactcataaagccactgcc

SEQ ID NO: 12547 - DNA, 20 bp, Artificial Sequence
  Description of Artificial Sequence: Synthetic oligonucleotide
  Target: AGXT; (+) strand; PAM type: NRG; PAM sequence: AGG
cactcataaagccactgcct

SEQ ID NO: 12548 - DNA, 20 bp, Artificial Sequence
  Description of Artificial Sequence: Synthetic oligonucleotide
  Target: AGXT; (+) strand; PAM type: NRG; PAM sequence: GGG
actcataaagccactgccta

SEQ ID NO: 12549 - DNA, 20 bp, Artificial Sequence
  Description of Artificial Sequence: Synthetic oligonucleotide
  Target: AGXT; (+) strand; PAM type: NRG; PAM sequence: TGG
ataaagccactgcctagggc

SEQ ID NO: 12550 - DNA, 20 bp, Artificial Sequence
  Description of Artificial Sequence: Synthetic oligonucleotide
  Target: AGXT; (+) strand; PAM type: NRG; PAM sequence: GGG
taaagccactgcctagggct

SEQ ID NO: 12551 - DNA, 20 bp, Artificial Sequence
  Description of Artificial Sequence: Synthetic oligonucleotide
  Target: AGXT; (+) strand; PAM type: NRG; PAM sequence: TAG
gccactgcctagggctgggt

SEQ ID NO: 12552 - DNA, 20 bp, Artificial Sequence
  Description of Artificial Sequence: Synthetic oligonucleotide
  Target: AGXT; (+) strand; PAM type: NRG; PAM sequence: CAG
gcctagggctgggttagtgc

SEQ ID NO: 12553 - DNA, 20 bp, Artificial Sequence
  Description of Artificial Sequence: Synthetic oligonucleotide
  Target: AGXT; (+) strand; PAM type: NRG; PAM sequence: AGG
cctagggctgggttagtgcc

SEQ ID NO: 12554 - DNA, 20 bp, Artificial Sequence
  Description of Artificial Sequence: Synthetic oligonucleotide
  Target: AGXT; (+) strand; PAM type: NRG; PAM sequence: GGG
ctagggctgggttagtgcca

SEQ ID NO: 12555 - DNA, 20 bp, Artificial Sequence
  Description of Artificial Sequence: Synthetic oligonucleotide
  Target: AGXT; (+) strand; PAM type: NRG; PAM sequence: AAG
tagtgccagggtgcccctgt

SEQ ID NO: 12556 - DNA, 20 bp, Artificial Sequence
  Description of Artificial Sequence: Synthetic oligonucleotide
  Target: AGXT; (+) strand; PAM type: NRG; PAM sequence: CGG
ctaaatgccacccgcacccg

SEQ ID NO: 12557 - DNA, 20 bp, Artificial Sequence
  Description of Artificial Sequence: Synthetic oligonucleotide
  Target: AGXT; (+) strand; PAM type: NRG; PAM sequence: GGG
taaatgccacccgcacccgc

SEQ ID NO: 12558 - DNA, 20 bp, Artificial Sequence
  Description of Artificial Sequence: Synthetic oligonucleotide
  Target: AGXT; (+) strand; PAM type: NRG; PAM sequence: GGG
aaatgccacccgcacccgcg

SEQ ID NO: 12559 - DNA, 20 bp, Artificial Sequence
  Description of Artificial Sequence: Synthetic oligonucleotide
  Target: AGXT; (+) strand; PAM type: NRG; PAM sequence: GGG
aatgccacccgcacccgcgg

SEQ ID NO: 12560 - DNA, 20 bp, Artificial Sequence
  Description of Artificial Sequence: Synthetic oligonucleotide
  Target: AGXT; (+) strand; PAM type: NRG; PAM sequence: AAG
gccacccgcacccgcggggg

SEQ ID NO: 12561 - DNA, 20 bp, Artificial Sequence
  Description of Artificial Sequence: Synthetic oligonucleotide
  Target: AGXT; (+) strand; PAM type: NRG; PAM sequence: AGG
ccacccgcacccgcggggga

SEQ ID NO: 12562 - DNA, 20 bp, Artificial Sequence
  Description of Artificial Sequence: Synthetic oligonucleotide
  Target: AGXT; (+) strand; PAM type: NRG; PAM sequence: GAG
ccgcacccgcgggggaaggc

SEQ ID NO: 12563 - DNA, 20 bp, Artificial Sequence
  Description of Artificial Sequence: Synthetic oligonucleotide
  Target: AGXT; (+) strand; PAM type: NRG; PAM sequence: AGG
cgcacccgcgggggaaggcg

SEQ ID NO: 12564 - DNA, 20 bp, Artificial Sequence
  Description of Artificial Sequence: Synthetic oligonucleotide
  Target: AGXT; (+) strand; PAM type: NRG; PAM sequence: GGG
gcacccgcgggggaaggcga

SEQ ID NO: 12565 - DNA, 20 bp, Artificial Sequence
  Description of Artificial Sequence: Synthetic oligonucleotide
  Target: AGXT; (+) strand; PAM type: NRG; PAM sequence: GGG
cacccgcgggggaaggcgag

SEQ ID NO: 12566 - DNA, 20 bp, Artificial Sequence
  Description of Artificial Sequence: Synthetic oligonucleotide
  Target: AGXT; (+) strand; PAM type: NRG; PAM sequence: CAG
cgcgggggaaggcgaggggt

SEQ ID NO: 12567 - DNA, 20 bp, Artificial Sequence
  Description of Artificial Sequence: Synthetic oligonucleotide
  Target: AGXT; (+) strand; PAM type: NRG; PAM sequence: AGG
gcgggggaaggcgaggggtc

SEQ ID NO: 12568 - DNA, 20 bp, Artificial Sequence
  Description of Artificial Sequence: Synthetic oligonucleotide
  Target: AGXT; (+) strand; PAM type: NRG; PAM sequence: CAG
cgaggggtcaggcgctcaca

SEQ ID NO: 12569 - DNA, 20 bp, Artificial Sequence
  Description of Artificial Sequence: Synthetic oligonucleotide
  Target: AGXT; (+) strand; PAM type: NRG; PAM sequence: AGG
gaggggtcaggcgctcacac

SEQ ID NO: 12570 - DNA, 20 bp, Artificial Sequence
  Description of Artificial Sequence: Synthetic oligonucleotide
  Target: AGXT; (+) strand; PAM type: NRG; PAM sequence: GGG
aggggtcaggcgctcacaca

SEQ ID NO: 12571 - DNA, 20 bp, Artificial Sequence
  Description of Artificial Sequence: Synthetic oligonucleotide
  Target: AGXT; (+) strand; PAM type: NRG; PAM sequence: AAG
gtcaggcgctcacacaggga

SEQ ID NO: 12572 - DNA, 20 bp, Artificial Sequence
  Description of Artificial Sequence: Synthetic oligonucleotide
  Target: AGXT; (+) strand; PAM type: NRG; PAM sequence: AGG
tcaggcgctcacacagggaa

SEQ ID NO: 12573 - DNA, 20 bp, Artificial Sequence
  Description of Artificial Sequence: Synthetic oligonucleotide
  Target: AGXT; (+) strand; PAM type: NRG; PAM sequence: TAG
gctcacacagggaaaggctc

SEQ ID NO: 12574 - DNA, 20 bp, Artificial Sequence
  Description of Artificial Sequence: Synthetic oligonucleotide
  Target: AGXT; (+) strand; PAM type: NRG; PAM sequence: AGG
ctcacacagggaaaggctct

SEQ ID NO: 12575 - DNA, 20 bp, Artificial Sequence
  Description of Artificial Sequence: Synthetic oligonucleotide
  Target: AGXT; (+) strand; PAM type: NRG; PAM sequence: GGG
tcacacagggaaaggctcta

SEQ ID NO: 12576 - DNA, 20 bp, Artificial Sequence
  Description of Artificial Sequence: Synthetic oligonucleotide
  Target: AGXT; (+) strand; PAM type: NRG; PAM sequence: AAG
ggaaaggctctagggtcgta

SEQ ID NO: 12577 - DNA, 20 bp, Artificial Sequence
  Description of Artificial Sequence: Synthetic oligonucleotide
  Target: AGXT; (+) strand; PAM type: NRG; PAM sequence: AGG
gaaaggctctagggtcgtaa

SEQ ID NO: 12578 - DNA, 20 bp, Artificial Sequence
  Description of Artificial Sequence: Synthetic oligonucleotide
  Target: AGXT; (+) strand; PAM type: NRG; PAM sequence: TGG
aggctctagggtcgtaaagg

SEQ ID NO: 12579 - DNA, 20 bp, Artificial Sequence
  Description of Artificial Sequence: Synthetic oligonucleotide
  Target: AGXT; (+) strand; PAM type: NRG; PAM sequence: GGG
ggctctagggtcgtaaaggt

SEQ ID NO: 12580 - DNA, 20 bp, Artificial Sequence
  Description of Artificial Sequence: Synthetic oligonucleotide
  Target: AGXT; (+) strand; PAM type: NRG; PAM sequence: TGG
tctagggtcgtaaaggtggg

SEQ ID NO: 12581 - DNA, 20 bp, Artificial Sequence
  Description of Artificial Sequence: Synthetic oligonucleotide
  Target: AGXT; (+) strand; PAM type: NRG; PAM sequence: GGG
ctagggtcgtaaaggtgggt

SEQ ID NO: 12582 - DNA, 20 bp, Artificial Sequence
  Description of Artificial Sequence: Synthetic oligonucleotide
  Target: AGXT; (+) strand; PAM type: NRG; PAM sequence: GGG
tagggtcgtaaaggtgggtg

SEQ ID NO: 12583 - DNA, 20 bp, Artificial Sequence
  Description of Artificial Sequence: Synthetic oligonucleotide
  Target: AGXT; (+) strand; PAM type: NRG; PAM sequence: GGG
agggtcgtaaaggtgggtgg

SEQ ID NO: 12584 - DNA, 20 bp, Artificial Sequence
  Description of Artificial Sequence: Synthetic oligonucleotide
  Target: AGXT; (+) strand; PAM type: NRG; PAM sequence: GGG
gggtcgtaaaggtgggtggg

SEQ ID NO: 12585 - DNA, 20 bp, Artificial Sequence
  Description of Artificial Sequence: Synthetic oligonucleotide
  Target: AGXT; (+) strand; PAM type: NRG; PAM sequence: GAG
taaaggtgggtggggggtgt

SEQ ID NO: 12586 - DNA, 20 bp, Artificial Sequence
  Description of Artificial Sequence: Synthetic oligonucleotide
  Target: AGXT; (+) strand; PAM type: NRG; PAM sequence: TGG
ggtgggtggggggtgtgagc

SEQ ID NO: 12587 - DNA, 20 bp, Artificial Sequence
  Description of Artificial Sequence: Synthetic oligonucleotide
  Target: AGXT; (+) strand; PAM type: NRG; PAM sequence: GGG
gtgggtggggggtgtgagct

SEQ ID NO: 12588 - DNA, 20 bp, Artificial Sequence
  Description of Artificial Sequence: Synthetic oligonucleotide
  Target: AGXT; (+) strand; PAM type: NRG; PAM sequence: CAG
ggtggggggtgtgagctggg

SEQ ID NO: 12589 - DNA, 20 bp, Artificial Sequence
  Description of Artificial Sequence: Synthetic oligonucleotide
  Target: AGXT; (+) strand; PAM type: NRG; PAM sequence: GAG
tggggggtgtgagctgggca

SEQ ID NO: 12590 - DNA, 20 bp, Artificial Sequence
  Description of Artificial Sequence: Synthetic oligonucleotide
  Target: AGXT; (+) strand; PAM type: NRG; PAM sequence: AAG
ggggtgtgagctgggcagag

SEQ ID NO: 12591 - DNA, 20 bp, Artificial Sequence
  Description of Artificial Sequence: Synthetic oligonucleotide
  Target: AGXT; (+) strand; PAM type: NRG; PAM sequence: AGG
gggtgtgagctgggcagaga

SEQ ID NO: 12592 - DNA, 20 bp, Artificial Sequence
  Description of Artificial Sequence: Synthetic oligonucleotide
  Target: AGXT; (+) strand; PAM type: NRG; PAM sequence: AAG
tgtgagctgggcagagaagg

SEQ ID NO: 12593 - DNA, 20 bp, Artificial Sequence
  Description of Artificial Sequence: Synthetic oligonucleotide
  Target: AGXT; (+) strand; PAM type: NRG; PAM sequence: GAG
tgagctgggcagagaaggaa

SEQ ID NO: 12594 - DNA, 20 bp, Artificial Sequence
  Description of Artificial Sequence: Synthetic oligonucleotide
  Target: AGXT; (+) strand; PAM type: NRG; PAM sequence: CAG
tgggcagagaaggaagagaa

SEQ ID NO: 12595 - DNA, 20 bp, Artificial Sequence
  Description of Artificial Sequence: Synthetic oligonucleotide
  Target: AGXT; (+) strand; PAM type: NRG; PAM sequence: AGG
gggcagagaaggaagagaac

SEQ ID NO: 12596 - DNA, 20 bp, Artificial Sequence
  Description of Artificial Sequence: Synthetic oligonucleotide
  Target: AGXT; (+) strand; PAM type: NRG; PAM sequence: CAG
gagaaggaagagaacaggac

SEQ ID NO: 12597 - DNA, 20 bp, Artificial Sequence
  Description of Artificial Sequence: Synthetic oligonucleotide
  Target: AGXT; (+) strand; PAM type: NRG; PAM sequence: CAG
aggaagagaacaggaccaga

SEQ ID NO: 12598 - DNA, 20 bp, Artificial Sequence
  Description of Artificial Sequence: Synthetic oligonucleotide
  Target: AGXT; (+) strand; PAM type: NRG; PAM sequence: CAG
aagagaacaggaccagacag

SEQ ID NO: 12599 - DNA, 20 bp, Artificial Sequence
  Description of Artificial Sequence: Synthetic oligonucleotide
  Target: AGXT; (+) strand; PAM type: NRG; PAM sequence: AGG
agagaacaggaccagacagc

SEQ ID NO: 12600 - DNA, 20 bp, Artificial Sequence
  Description of Artificial Sequence: Synthetic oligonucleotide
  Target: AGXT; (+) strand; PAM type: NRG; PAM sequence: GGG
gagaacaggaccagacagca

SEQ ID NO: 12601 - DNA, 20 bp, Artificial Sequence
  Description of Artificial Sequence: Synthetic oligonucleotide
  Target: AGXT; (+) strand; PAM type: NRG; PAM sequence: CAG
caggaccagacagcagggca

SEQ ID NO: 12602 - DNA, 20 bp, Artificial Sequence
  Description of Artificial Sequence: Synthetic oligonucleotide
  Target: AGXT; (+) strand; PAM type: NRG; PAM sequence: AAG
ccagacagcagggcacagtc

SEQ ID NO: 12603 - DNA, 20 bp, Artificial Sequence
  Description of Artificial Sequence: Synthetic oligonucleotide
  Target: AGXT; (+) strand; PAM type: NRG; PAM sequence: AGG
cagacagcagggcacagtca

SEQ ID NO: 12604 - DNA, 20 bp, Artificial Sequence
  Description of Artificial Sequence: Synthetic oligonucleotide
  Target: AGXT; (+) strand; PAM type: NRG; PAM sequence: GGG
agacagcagggcacagtcaa

SEQ ID NO: 12605 - DNA, 20 bp, Artificial Sequence
  Description of Artificial Sequence: Synthetic oligonucleotide
  Target: AGXT; (+) strand; PAM type: NRG; PAM sequence: CAG
cagcagggcacagtcaaggg

SEQ ID NO: 12606 - DNA, 20 bp, Artificial Sequence
  Description of Artificial Sequence: Synthetic oligonucleotide
  Target: AGXT; (+) strand; PAM type: NRG; PAM sequence: GAG
gcagggcacagtcaagggca

SEQ ID NO: 12607 - DNA, 20 bp, Artificial Sequence
  Description of Artificial Sequence: Synthetic oligonucleotide
  Target: AGXT; (+) strand; PAM type: NRG; PAM sequence: AGG
cagggcacagtcaagggcag

SEQ ID NO: 12608 - DNA, 20 bp, Artificial Sequence
  Description of Artificial Sequence: Synthetic oligonucleotide
  Target: AGXT; (+) strand; PAM type: NRG; PAM sequence: CAG
cacagtcaagggcagaggca

SEQ ID NO: 12609 - DNA, 20 bp, Artificial Sequence
  Description of Artificial Sequence: Synthetic oligonucleotide
  Target: AGXT; (+) strand; PAM type: NRG; PAM sequence: AGG
acagtcaagggcagaggcac

SEQ ID NO: 12610 - DNA, 20 bp, Artificial Sequence
  Description of Artificial Sequence: Synthetic oligonucleotide
  Target: AGXT; (+) strand; PAM type: NRG; PAM sequence: GGG
cagtcaagggcagaggcaca

SEQ ID NO: 12611 - DNA, 20 bp, Artificial Sequence
  Description of Artificial Sequence: Synthetic oligonucleotide
  Target: AGXT; (+) strand; PAM type: NRG; PAM sequence: TGG
agggcagaggcacagggacc

SEQ ID NO: 12612 - DNA, 20 bp, Artificial Sequence
  Description of Artificial Sequence: Synthetic oligonucleotide
  Target: AGXT; (+) strand; PAM type: NRG; PAM sequence: CAG
gcagaggcacagggacctgg

SEQ ID NO: 12613 - DNA, 20 bp, Artificial Sequence
  Description of Artificial Sequence: Synthetic oligonucleotide
  Target: AGXT; (+) strand; PAM type: NRG; PAM sequence: GAG
agaggcacagggacctggca

SEQ ID NO: 12614 - DNA, 20 bp, Artificial Sequence
  Description of Artificial Sequence: Synthetic oligonucleotide
  Target: AGXT; (+) strand; PAM type: NRG; PAM sequence: CAG
cacagggacctggcagagtg

SEQ ID NO: 12615 - DNA, 20 bp, Artificial Sequence
  Description of Artificial Sequence: Synthetic oligonucleotide
  Target: AGXT; (+) strand; PAM type: NRG; PAM sequence: CAG
acctggcagagtgcagattg

SEQ ID NO: 12616 - DNA, 20 bp, Artificial Sequence
  Description of Artificial Sequence: Synthetic oligonucleotide
  Target: AGXT; (+) strand; PAM type: NRG; PAM sequence: AGG
cctggcagagtgcagattgc

SEQ ID NO: 12617 - DNA, 20 bp, Artificial Sequence
  Description of Artificial Sequence: Synthetic oligonucleotide
  Target: AGXT; (+) strand; PAM type: NRG; PAM sequence: GGG
ctggcagagtgcagattgca

SEQ ID NO: 12618 - DNA, 20 bp, Artificial Sequence
  Description of Artificial Sequence: Synthetic oligonucleotide
  Target: AGXT; (+) strand; PAM type: NRG; PAM sequence: GGG
tggcagagtgcagattgcag

SEQ ID NO: 12619 - DNA, 20 bp, Artificial Sequence
  Description of Artificial Sequence: Synthetic oligonucleotide
  Target: AGXT; (+) strand; PAM type: NRG; PAM sequence: CAG
agattgcaggggcacatgcg

SEQ ID NO: 12620 - DNA, 20 bp, Artificial Sequence
  Description of Artificial Sequence: Synthetic oligonucleotide
  Target: AGXT; (+) strand; PAM type: NRG; PAM sequence: GAG
attgcaggggcacatgcgca

SEQ ID NO: 12621 - DNA, 20 bp, Artificial Sequence
  Description of Artificial Sequence: Synthetic oligonucleotide
  Target: AGXT; (+) strand; PAM type: NRG; PAM sequence: AAG
gcaggggcacatgcgcagag

SEQ ID NO: 12622 - DNA, 20 bp, Artificial Sequence
  Description of Artificial Sequence: Synthetic oligonucleotide
  Target: AGXT; (+) strand; PAM type: NRG; PAM sequence: CGG
gggcacatgcgcagagaaga

SEQ ID NO: 12623 - DNA, 20 bp, Artificial Sequence
  Description of Artificial Sequence: Synthetic oligonucleotide
  Target: AGXT; (+) strand; PAM type: NRG; PAM sequence: GGG
ggcacatgcgcagagaagac

SEQ ID NO: 12624 - DNA, 20 bp, Artificial Sequence
  Description of Artificial Sequence: Synthetic oligonucleotide
  Target: AGXT; (+) strand; PAM type: NRG; PAM sequence: CAG
catgcgcagagaagacgggc

SEQ ID NO: 12625 - DNA, 20 bp, Artificial Sequence
  Description of Artificial Sequence: Synthetic oligonucleotide
  Target: AGXT; (+) strand; PAM type: NRG; PAM sequence: AGG
atgcgcagagaagacgggcc

SEQ ID NO: 12626 - DNA, 20 bp, Artificial Sequence
  Description of Artificial Sequence: Synthetic oligonucleotide
  Target: AGXT; (+) strand; PAM type: NRG; PAM sequence: GGG
tgcgcagagaagacgggcca

SEQ ID NO: 12627 - DNA, 20 bp, Artificial Sequence
  Description of Artificial Sequence: Synthetic oligonucleotide
  Target: AGXT; (+) strand; PAM type: NRG; PAM sequence: CAG
cagagaagacgggccagggc

SEQ ID NO: 12628 - DNA, 20 bp, Artificial Sequence
  Description of Artificial Sequence: Synthetic oligonucleotide
  Target: AGXT; (+) strand; PAM type: NRG; PAM sequence: GAG
gagaagacgggccagggcca

SEQ ID NO: 12629 - DNA, 20 bp, Artificial Sequence
  Description of Artificial Sequence: Synthetic oligonucleotide
  Target: AGXT; (+) strand; PAM type: NRG; PAM sequence: TAG
aagacgggccagggccagag

SEQ ID NO: 12630 - DNA, 20 bp, Artificial Sequence
  Description of Artificial Sequence: Synthetic oligonucleotide
  Target: AGXT; (+) strand; PAM type: NRG; PAM sequence: GAG
gacgggccagggccagagta

SEQ ID NO: 12631 - DNA, 20 bp, Artificial Sequence
  Description of Artificial Sequence: Synthetic oligonucleotide
  Target: AGXT; (+) strand; PAM type: NRG; PAM sequence: GAG
cgggccagggccagagtaga

SEQ ID NO: 12632 - DNA, 20 bp, Artificial Sequence
  Description of Artificial Sequence: Synthetic oligonucleotide
  Target: AGXT; (+) strand; PAM type: NRG; PAM sequence: CAG
gccagggccagagtagagag

SEQ ID NO: 12633 - DNA, 20 bp, Artificial Sequence
  Description of Artificial Sequence: Synthetic oligonucleotide
  Target: AGXT; (+) strand; PAM type: NRG; PAM sequence: CGG
gtagagagcagctgctgctc

SEQ ID NO: 12634 - DNA, 20 bp, Artificial Sequence
  Description of Artificial Sequence: Synthetic oligonucleotide
  Target: AGXT; (+) strand; PAM type: NRG; PAM sequence: GGG
tagagagcagctgctgctcc

SEQ ID NO: 12635 - DNA, 20 bp, Artificial Sequence
  Description of Artificial Sequence: Synthetic oligonucleotide
  Target: AGXT; (+) strand; PAM type: NRG; PAM sequence: GGG
agagagcagctgctgctccg

SEQ ID NO: 12636 - DNA, 20 bp, Artificial Sequence
  Description of Artificial Sequence: Synthetic oligonucleotide
  Target: AGXT; (+) strand; PAM type: NRG; PAM sequence: TGG
tgctgctccggggacccacc

SEQ ID NO: 12637 - DNA, 20 bp, Artificial Sequence
  Description of Artificial Sequence: Synthetic oligonucleotide
  Target: AGXT; (+) strand; PAM type: NRG; PAM sequence: GGG
gctgctccggggacccacct

SEQ ID NO: 12638 - DNA, 20 bp, Artificial Sequence
  Description of Artificial Sequence: Synthetic oligonucleotide
  Target: AGXT; (+) strand; PAM type: NRG; PAM sequence: GGG
ctgctccggggacccacctg

SEQ ID NO: 12639 - DNA, 20 bp, Artificial Sequence
  Description of Artificial Sequence: Synthetic oligonucleotide
  Target: AGXT; (+) strand; PAM type: NRG; PAM sequence: TGG
ctccggggacccacctgggg

SEQ ID NO: 12640 - DNA, 20 bp, Artificial Sequence
  Description of Artificial Sequence: Synthetic oligonucleotide
  Target: AGXT; (+) strand; PAM type: NRG; PAM sequence: GAG
gacccacctggggtggccat

SEQ ID NO: 12641 - DNA, 20 bp, Artificial Sequence
  Description of Artificial Sequence: Synthetic oligonucleotide
  Target: AGXT; (+) strand; PAM type: NRG; PAM sequence: GAG
cccacctggggtggccatga

SEQ ID NO: 12642 - DNA, 20 bp, Artificial Sequence
  Description of Artificial Sequence: Synthetic oligonucleotide
  Target: AGXT; (+) strand; PAM type: NRG; PAM sequence: TGG
cctggggtggccatgagagc

SEQ ID NO: 12643 - DNA, 20 bp, Artificial Sequence
  Description of Artificial Sequence: Synthetic oligonucleotide
  Target: AGXT; (+) strand; PAM type: NRG; PAM sequence: TGG
ggggtggccatgagagctgg

SEQ ID NO: 12644 - DNA, 20 bp, Artificial Sequence
  Description of Artificial Sequence: Synthetic oligonucleotide
  Target: AGXT; (+) strand; PAM type: NRG; PAM sequence: TGG
tggccatgagagctggtggc

SEQ ID NO: 12645 - DNA, 20 bp, Artificial Sequence
  Description of Artificial Sequence: Synthetic oligonucleotide
  Target: AGXT; (+) strand; PAM type: NRG; PAM sequence: GAG
gccatgagagctggtggctg

SEQ ID NO: 12646 - DNA, 20 bp, Artificial Sequence
  Description of Artificial Sequence: Synthetic oligonucleotide
  Target: AGXT; (+) strand; PAM type: NRG; PAM sequence: AGG
ccatgagagctggtggctgg

SEQ ID NO: 12647 - DNA, 20 bp, Artificial Sequence
  Description of Artificial Sequence: Synthetic oligonucleotide
  Target: AGXT; (+) strand; PAM type: NRG; PAM sequence: CGG
gagagctggtggctggaggc

SEQ ID NO: 12648 - DNA, 20 bp, Artificial Sequence
  Description of Artificial Sequence: Synthetic oligonucleotide
  Target: AGXT; (+) strand; PAM type: NRG; PAM sequence: GGG
agagctggtggctggaggcc

SEQ ID NO: 12649 - DNA, 20 bp, Artificial Sequence
  Description of Artificial Sequence: Synthetic oligonucleotide
  Target: AGXT; (+) strand; PAM type: NRG; PAM sequence: GAG
agctggtggctggaggccgg

SEQ ID NO: 12650 - DNA, 20 bp, Artificial Sequence
  Description of Artificial Sequence: Synthetic oligonucleotide
  Target: AGXT; (+) strand; PAM type: NRG; PAM sequence: AGG
gctggtggctggaggccggg

SEQ ID NO: 12651 - DNA, 20 bp, Artificial Sequence
  Description of Artificial Sequence: Synthetic oligonucleotide
  Target: AGXT; (+) strand; PAM type: NRG; PAM sequence: CAG
aggccgggaggacccgtgac

SEQ ID NO: 12652 - DNA, 20 bp, Artificial Sequence
  Description of Artificial Sequence: Synthetic oligonucleotide
  Target: AGXT; (+) strand; PAM type: NRG; PAM sequence: GAG
gccgggaggacccgtgacca

SEQ ID NO: 12653 - DNA, 20 bp, Artificial Sequence
  Description of Artificial Sequence: Synthetic oligonucleotide
  Target: AGXT; (+) strand; PAM type: NRG; PAM sequence: AGG
ccgggaggacccgtgaccag

SEQ ID NO: 12654 - DNA, 20 bp, Artificial Sequence
  Description of Artificial Sequence: Synthetic oligonucleotide
  Target: AGXT; (+) strand; PAM type: NRG; PAM sequence: TGG
ggacccgtgaccagaggtaa

SEQ ID NO: 12655 - DNA, 20 bp, Artificial Sequence
  Description of Artificial Sequence: Synthetic oligonucleotide
  Target: AGXT; (+) strand; PAM type: NRG; PAM sequence: GAG
tgaccagaggtaatggcact

SEQ ID NO: 12656 - DNA, 20 bp, Artificial Sequence
  Description of Artificial Sequence: Synthetic oligonucleotide
  Target: AGXT; (+) strand; PAM type: NRG; PAM sequence: AGG
gaccagaggtaatggcactg

SEQ ID NO: 12657 - DNA, 20 bp, Artificial Sequence
  Description of Artificial Sequence: Synthetic oligonucleotide
  Target: AGXT; (+) strand; PAM type: NRG; PAM sequence: GGG
accagaggtaatggcactga

SEQ ID NO: 12658 - DNA, 20 bp, Artificial Sequence
  Description of Artificial Sequence: Synthetic oligonucleotide
  Target: AGXT; (+) strand; PAM type: NRG; PAM sequence: GGG
ccagaggtaatggcactgag

SEQ ID NO: 12659 - DNA, 20 bp, Artificial Sequence
  Description of Artificial Sequence: Synthetic oligonucleotide
  Target: AGXT; (+) strand; PAM type: NRG; PAM sequence: CAG
ggtaatggcactgaggggcc

SEQ ID NO: 12660 - DNA, 20 bp, Artificial Sequence
  Description of Artificial Sequence: Synthetic oligonucleotide
  Target: AGXT; (+) strand; PAM type: NRG; PAM sequence: AGG
gtaatggcactgaggggccc

SEQ ID NO: 12661 - DNA, 20 bp, Artificial Sequence
  Description of Artificial Sequence: Synthetic oligonucleotide
  Target: AGXT; (+) strand; PAM type: NRG; PAM sequence: GGG
taatggcactgaggggccca

SEQ ID NO: 12662 - DNA, 20 bp, Artificial Sequence
  Description of Artificial Sequence: Synthetic oligonucleotide
  Target: AGXT; (+) strand; PAM type: NRG; PAM sequence: TGG
ggcactgaggggcccagggc

SEQ ID NO: 12663 - DNA, 20 bp, Artificial Sequence
  Description of Artificial Sequence: Synthetic oligonucleotide
  Target: AGXT; (+) strand; PAM type: NRG; PAM sequence: GAG
cactgaggggcccagggctg

SEQ ID NO: 12664 - DNA, 20 bp, Artificial Sequence
  Description of Artificial Sequence: Synthetic oligonucleotide
  Target: AGXT; (+) strand; PAM type: NRG; PAM sequence: GAG
ctgaggggcccagggctgga

SEQ ID NO: 12665 - DNA, 20 bp, Artificial Sequence
  Description of Artificial Sequence: Synthetic oligonucleotide
  Target: AGXT; (+) strand; PAM type: NRG; PAM sequence: CAG
gagaccacccctcacctgtc

SEQ ID NO: 12666 - DNA, 20 bp, Artificial Sequence
  Description of Artificial Sequence: Synthetic oligonucleotide
  Target: AGXT; (+) strand; PAM type: NRG; PAM sequence: GAG
gaccacccctcacctgtcca

SEQ ID NO: 12667 - DNA, 20 bp, Artificial Sequence
  Description of Artificial Sequence: Synthetic oligonucleotide
  Target: AGXT; (+) strand; PAM type: NRG; PAM sequence: GAG
cccctcacctgtccagagct

SEQ ID NO: 12668 - DNA, 20 bp, Artificial Sequence
  Description of Artificial Sequence: Synthetic oligonucleotide
  Target: AGXT; (+) strand; PAM type: NRG; PAM sequence: AGG
ccctcacctgtccagagctg

SEQ ID NO: 12669 - DNA, 20 bp, Artificial Sequence
  Description of Artificial Sequence: Synthetic oligonucleotide
  Target: AGXT; (+) strand; PAM type: NRG; PAM sequence: CAG
tcacctgtccagagctgagg

SEQ ID NO: 12670 - DNA, 20 bp, Artificial Sequence
  Description of Artificial Sequence: Synthetic oligonucleotide
  Target: AGXT; (+) strand; PAM type: NRG; PAM sequence: AGG
cacctgtccagagctgaggc

SEQ ID NO: 12671 - DNA, 20 bp, Artificial Sequence
  Description of Artificial Sequence: Synthetic oligonucleotide
  Target: AGXT; (+) strand; PAM type: NRG; PAM sequence: GAG
cctgtccagagctgaggcag

SEQ ID NO: 12672 - DNA, 20 bp, Artificial Sequence
  Description of Artificial Sequence: Synthetic oligonucleotide
  Target: AGXT; (+) strand; PAM type: NRG; PAM sequence: CAG
gtccagagctgaggcaggag

SEQ ID NO: 12673 - DNA, 20 bp, Artificial Sequence
  Description of Artificial Sequence: Synthetic oligonucleotide
  Target: AGXT; (+) strand; PAM type: NRG; PAM sequence: CGG
ctgaggcaggagcagtgctg

SEQ ID NO: 12674 - DNA, 20 bp, Artificial Sequence
  Description of Artificial Sequence: Synthetic oligonucleotide
  Target: AGXT; (+) strand; PAM type: NRG; PAM sequence: GAG
gaggcaggagcagtgctgcg

SEQ ID NO: 12675 - DNA, 20 bp, Artificial Sequence
  Description of Artificial Sequence: Synthetic oligonucleotide
  Target: AGXT; (+) strand; PAM type: NRG; PAM sequence: AGG
aggcaggagcagtgctgcgg

SEQ ID NO: 12676 - DNA, 20 bp, Artificial Sequence
  Description of Artificial Sequence: Synthetic oligonucleotide
  Target: AGXT; (+) strand; PAM type: NRG; PAM sequence: CAG
agcagtgctgcggaggatgc

SEQ ID NO: 12677 - DNA, 20 bp, Artificial Sequence
  Description of Artificial Sequence: Synthetic oligonucleotide
  Target: AGXT; (+) strand; PAM type: NRG; PAM sequence: AGG
gcagtgctgcggaggatgcc

SEQ ID NO: 12678 - DNA, 20 bp, Artificial Sequence
  Description of Artificial Sequence: Synthetic oligonucleotide
  Target: AGXT; (+) strand; PAM type: NRG; PAM sequence: CGG
tgctgcggaggatgccaggt

SEQ ID NO: 12679 - DNA, 20 bp, Artificial Sequence
  Description of Artificial Sequence: Synthetic oligonucleotide
  Target: AGXT; (+) strand; PAM type: NRG; PAM sequence: GGG
gctgcggaggatgccaggtc

SEQ ID NO: 12680 - DNA, 20 bp, Artificial Sequence
  Description of Artificial Sequence: Synthetic oligonucleotide
  Target: AGXT; (+) strand; PAM type: NRG; PAM sequence: GGG
ctgcggaggatgccaggtcg

SEQ ID NO: 12681 - DNA, 20 bp, Artificial Sequence
  Description of Artificial Sequence: Synthetic oligonucleotide
  Target: AGXT; (+) strand; PAM type: NRG; PAM sequence: GGG
tgcggaggatgccaggtcgg

SEQ ID NO: 12682 - DNA, 20 bp, Artificial Sequence
  Description of Artificial Sequence: Synthetic oligonucleotide
  Target: AGXT; (+) strand; PAM type: NRG; PAM sequence: GAG
cggaggatgccaggtcgggg

SEQ ID NO: 12683 - DNA, 20 bp, Artificial Sequence
  Description of Artificial Sequence: Synthetic oligonucleotide
  Target: AGXT; (+) strand; PAM type: NRG; PAM sequence: TGG
ggatgccaggtcgggggagc

SEQ ID NO: 12684 - DNA, 20 bp, Artificial Sequence
  Description of Artificial Sequence: Synthetic oligonucleotide
  Target: AGXT; (+) strand; PAM type: NRG; PAM sequence: GAG
aggtcgggggagctggccct

SEQ ID NO: 12685 - DNA, 20 bp, Artificial Sequence
  Description of Artificial Sequence: Synthetic oligonucleotide
  Target: AGXT; (+) strand; PAM type: NRG; PAM sequence: GAG
gtcgggggagctggccctga

SEQ ID NO: 12686 - DNA, 20 bp, Artificial Sequence
  Description of Artificial Sequence: Synthetic oligonucleotide
  Target: AGXT; (+) strand; PAM type: NRG; PAM sequence: AGG
tcgggggagctggccctgag

SEQ ID NO: 12687 - DNA, 20 bp, Artificial Sequence
  Description of Artificial Sequence: Synthetic oligonucleotide
  Target: AGXT; (+) strand; PAM type: NRG; PAM sequence: GAG
gggggagctggccctgagag

SEQ ID NO: 12688 - DNA, 20 bp, Artificial Sequence
  Description of Artificial Sequence: Synthetic oligonucleotide
  Target: AGXT; (+) strand; PAM type: NRG; PAM sequence: GAG
gggagctggccctgagagga

SEQ ID NO: 12689 - DNA, 20 bp, Artificial Sequence
  Description of Artificial Sequence: Synthetic oligonucleotide
  Target: AGXT; (+) strand; PAM type: NRG; PAM sequence: AGG
ggagctggccctgagaggag

SEQ ID NO: 12690 - DNA, 20 bp, Artificial Sequence
  Description of Artificial Sequence: Synthetic oligonucleotide
  Target: AGXT; (+) strand; PAM type: NRG; PAM sequence: GGG
gagctggccctgagaggaga

SEQ ID NO: 12691 - DNA, 20 bp, Artificial Sequence
  Description of Artificial Sequence: Synthetic oligonucleotide
  Target: AGXT; (+) strand; PAM type: NRG; PAM sequence: GGG
agctggccctgagaggagag

SEQ ID NO: 12692 - DNA, 20 bp, Artificial Sequence
  Description of Artificial Sequence: Synthetic oligonucleotide
  Target: AGXT; (+) strand; PAM type: NRG; PAM sequence: GGG
gctggccctgagaggagagg

SEQ ID NO: 12693 - DNA, 20 bp, Artificial Sequence
  Description of Artificial Sequence: Synthetic oligonucleotide
  Target: AGXT; (+) strand; PAM type: NRG; PAM sequence: TGG
ccctgagaggagagggggcc

SEQ ID NO: 12694 - DNA, 20 bp, Artificial Sequence
  Description of Artificial Sequence: Synthetic oligonucleotide
  Target: AGXT; (+) strand; PAM type: NRG; PAM sequence: GGG
cctgagaggagagggggcct

SEQ ID NO: 12695 - DNA, 20 bp, Artificial Sequence
  Description of Artificial Sequence: Synthetic oligonucleotide
  Target: AGXT; (+) strand; PAM type: NRG; PAM sequence: GAG
tgagaggagagggggcctgg

SEQ ID NO: 12696 - DNA, 20 bp, Artificial Sequence
  Description of Artificial Sequence: Synthetic oligonucleotide
  Target: AGXT; (+) strand; PAM type: NRG; PAM sequence: CAG
aggagagggggcctgggagc

SEQ ID NO: 12697 - DNA, 20 bp, Artificial Sequence
  Description of Artificial Sequence: Synthetic oligonucleotide
  Target: AGXT; (+) strand; PAM type: NRG; PAM sequence: GAG
ggcctgggagccagcaccct

SEQ ID NO: 12698 - DNA, 20 bp, Artificial Sequence
  Description of Artificial Sequence: Synthetic oligonucleotide
  Target: AGXT; (+) strand; PAM type: NRG; PAM sequence: TGG
ggagccagcaccctgagccc

SEQ ID NO: 12699 - DNA, 20 bp, Artificial Sequence
  Description of Artificial Sequence: Synthetic oligonucleotide
  Target: AGXT; (+) strand; PAM type: NRG; PAM sequence: CAG
gccctggccctgatccactc

SEQ ID NO: 12700 - DNA, 20 bp, Artificial Sequence
  Description of Artificial Sequence: Synthetic oligonucleotide
  Target: AGXT; (+) strand; PAM type: NRG; PAM sequence: TAG
tgatccactccagccctgtg

SEQ ID NO: 12701 - DNA, 20 bp, Artificial Sequence
  Description of Artificial Sequence: Synthetic oligonucleotide
  Target: AGXT; (+) strand; PAM type: NRG; PAM sequence: CAG
tccagccctgtgtagcccaa

SEQ ID NO: 12702 - DNA, 20 bp, Artificial Sequence
  Description of Artificial Sequence: Synthetic oligonucleotide
  Target: AGXT; (+) strand; PAM type: NRG; PAM sequence: CAG
cagcccttcccctccttgcc

SEQ ID NO: 12703 - DNA, 20 bp, Artificial Sequence
  Description of Artificial Sequence: Synthetic oligonucleotide
  Target: AGXT; (+) strand; PAM type: NRG; PAM sequence: AAG
gcccagtcccctccccctgc

SEQ ID NO: 12704 - DNA, 20 bp, Artificial Sequence
  Description of Artificial Sequence: Synthetic oligonucleotide
  Target: AGXT; (+) strand; PAM type: NRG; PAM sequence: AGG
cccagtcccctccccctgca

SEQ ID NO: 12705 - DNA, 20 bp, Artificial Sequence
  Description of Artificial Sequence: Synthetic oligonucleotide
  Target: AGXT; (+) strand; PAM type: NRG; PAM sequence: CAG
cactctccactcttctcccc

SEQ ID NO: 12706 - DNA, 20 bp, Artificial Sequence
  Description of Artificial Sequence: Synthetic oligonucleotide
  Target: AGXT; (+) strand; PAM type: NRG; PAM sequence: AGG
actctccactcttctccccc

SEQ ID NO: 12707 - DNA, 20 bp, Artificial Sequence
  Description of Artificial Sequence: Synthetic oligonucleotide
  Target: AGXT; (+) strand; PAM type: NRG; PAM sequence: GGG
ctctccactcttctccccca

SEQ ID NO: 12708 - DNA, 20 bp, Artificial Sequence
  Description of Artificial Sequence: Synthetic oligonucleotide
  Target: AGXT; (+) strand; PAM type: NRG; PAM sequence: GGG
tctccactcttctcccccag

SEQ ID NO: 12709 - DNA, 20 bp, Artificial Sequence
  Description of Artificial Sequence: Synthetic oligonucleotide
  Target: AGXT; (+) strand; PAM type: NRG; PAM sequence: CAG
ctcttctcccccaggggcca

SEQ ID NO: 12710 - DNA, 20 bp, Artificial Sequence
  Description of Artificial Sequence: Synthetic oligonucleotide
  Target: AGXT; (+) strand; PAM type: NRG; PAM sequence: AGG
tcttctcccccaggggccac

SEQ ID NO: 12711 - DNA, 20 bp, Artificial Sequence
  Description of Artificial Sequence: Synthetic oligonucleotide
  Target: AGXT; (+) strand; PAM type: NRG; PAM sequence: CAG
tctcccccaggggccacagg

SEQ ID NO: 12712 - DNA, 20 bp, Artificial Sequence
  Description of Artificial Sequence: Synthetic oligonucleotide
  Target: AGXT; (+) strand; PAM type: NRG; PAM sequence: CAG
gaaccctcctctgtctctcc

SEQ ID NO: 12713 - DNA, 20 bp, Artificial Sequence
  Description of Artificial Sequence: Synthetic oligonucleotide
  Target: AGXT; (+) strand; PAM type: NRG; PAM sequence: CAG
tcctctgtctctcccagacc

SEQ ID NO: 12714 - DNA, 20 bp, Artificial Sequence
  Description of Artificial Sequence: Synthetic oligonucleotide
  Target: AGXT; (+) strand; PAM type: NRG; PAM sequence: TGG
ccagatgtttccttctgccc

SEQ ID NO: 12715 - DNA, 20 bp, Artificial Sequence
  Description of Artificial Sequence: Synthetic oligonucleotide
  Target: AGXT; (+) strand; PAM type: NRG; PAM sequence: GGG
cagatgtttccttctgccct

SEQ ID NO: 12716 - DNA, 20 bp, Artificial Sequence
  Description of Artificial Sequence: Synthetic oligonucleotide
  Target: AGXT; (+) strand; PAM type: NRG; PAM sequence: GGG
agatgtttccttctgccctg

SEQ ID NO: 12717 - DNA, 20 bp, Artificial Sequence
  Description of Artificial Sequence: Synthetic oligonucleotide
  Target: AGXT; (+) strand; PAM type: NRG; PAM sequence: TAG
tgtttccttctgccctgggg

SEQ ID NO: 12718 - DNA, 20 bp, Artificial Sequence
  Description of Artificial Sequence: Synthetic oligonucleotide
  Target: AGXT; (+) strand; PAM type: NRG; PAM sequence: CAG
cttctgccctggggtagtcc

SEQ ID NO: 12719 - DNA, 20 bp, Artificial Sequence
  Description of Artificial Sequence: Synthetic oligonucleotide
  Target: AGXT; (+) strand; PAM type: NRG; PAM sequence: AGG
ttctgccctggggtagtccc

SEQ ID NO: 12720 - DNA, 20 bp, Artificial Sequence
  Description of Artificial Sequence: Synthetic oligonucleotide
  Target: AGXT; (+) strand; PAM type: NRG; PAM sequence: CAG
ggtagtcccaggccctgccc

SEQ ID NO: 12721 - DNA, 20 bp, Artificial Sequence
  Description of Artificial Sequence: Synthetic oligonucleotide
  Target: AGXT; (+) strand; PAM type: NRG; PAM sequence: AGG
gtagtcccaggccctgcccc

SEQ ID NO: 12722 - DNA, 20 bp, Artificial Sequence
  Description of Artificial Sequence: Synthetic oligonucleotide
  Target: AGXT; (+) strand; PAM type: NRG; PAM sequence: AAG
cccaggccctgccccaggca

SEQ ID NO: 12723 - DNA, 20 bp, Artificial Sequence
  Description of Artificial Sequence: Synthetic oligonucleotide
  Target: AGXT; (+) strand; PAM type: NRG; PAM sequence: TGG
tgccccaggcaaagtcaaac

SEQ ID NO: 12724 - DNA, 20 bp, Artificial Sequence
  Description of Artificial Sequence: Synthetic oligonucleotide
  Target: AGXT; (+) strand; PAM type: NRG; PAM sequence: GGG
gccccaggcaaagtcaaact

SEQ ID NO: 12725 - DNA, 20 bp, Artificial Sequence
  Description of Artificial Sequence: Synthetic oligonucleotide
  Target: AGXT; (+) strand; PAM type: NRG; PAM sequence: GGG
ccccaggcaaagtcaaactg

SEQ ID NO: 12726 - DNA, 20 bp, Artificial Sequence
  Description of Artificial Sequence: Synthetic oligonucleotide
  Target: AGXT; (+) strand; PAM type: NRG; PAM sequence: GGG
cccaggcaaagtcaaactgg

SEQ ID NO: 12727 - DNA, 20 bp, Artificial Sequence
  Description of Artificial Sequence: Synthetic oligonucleotide
  Target: AGXT; (+) strand; PAM type: NRG; PAM sequence: CAG
caaagtcaaactgggggctc

SEQ ID NO: 12728 - DNA, 20 bp, Artificial Sequence
  Description of Artificial Sequence: Synthetic oligonucleotide
  Target: AGXT; (+) strand; PAM type: NRG; PAM sequence: AGG
aaagtcaaactgggggctcc

SEQ ID NO: 12729 - DNA, 20 bp, Artificial Sequence
  Description of Artificial Sequence: Synthetic oligonucleotide
  Target: AGXT; (+) strand; PAM type: NRG; PAM sequence: GGG
aagtcaaactgggggctcca

SEQ ID NO: 12730 - DNA, 20 bp, Artificial Sequence
  Description of Artificial Sequence: Synthetic oligonucleotide
  Target: AGXT; (+) strand; PAM type: NRG; PAM sequence: GGG
agtcaaactgggggctccag

SEQ ID NO: 12731 - DNA, 20 bp, Artificial Sequence
  Description of Artificial Sequence: Synthetic oligonucleotide
  Target: AGXT; (+) strand; PAM type: NRG; PAM sequence: AAG
tccaggggctcccctgcacc

SEQ ID NO: 12732 - DNA, 20 bp, Artificial Sequence
  Description of Artificial Sequence: Synthetic oligonucleotide
  Target: AGXT; (+) strand; PAM type: NRG; PAM sequence: AGG
ccaggggctcccctgcacca

SEQ ID NO: 12733 - DNA, 20 bp, Artificial Sequence
  Description of Artificial Sequence: Synthetic oligonucleotide
  Target: AGXT; (+) strand; PAM type: NRG; PAM sequence: CAG
ctcccctgcaccaaggcctg

SEQ ID NO: 12734 - DNA, 20 bp, Artificial Sequence
  Description of Artificial Sequence: Synthetic oligonucleotide
  Target: AGXT; (+) strand; PAM type: NRG; PAM sequence: GAG
cccctgcaccaaggcctgca

SEQ ID NO: 12735 - DNA, 20 bp, Artificial Sequence
  Description of Artificial Sequence: Synthetic oligonucleotide
  Target: AGXT; (+) strand; PAM type: NRG; PAM sequence: CAG
tgcaccaaggcctgcagagt

SEQ ID NO: 12736 - DNA, 20 bp, Artificial Sequence
  Description of Artificial Sequence: Synthetic oligonucleotide
  Target: AGXT; (+) strand; PAM type: NRG; PAM sequence: AGG
gcaccaaggcctgcagagtc

SEQ ID NO: 12737 - DNA, 20 bp, Artificial Sequence
  Description of Artificial Sequence: Synthetic oligonucleotide
  Target: AGXT; (+) strand; PAM type: NRG; PAM sequence: CAG
aggttcttcctcccgcacca

SEQ ID NO: 12738 - DNA, 20 bp, Artificial Sequence
  Description of Artificial Sequence: Synthetic oligonucleotide
  Target: AGXT; (+) strand; PAM type: NRG; PAM sequence: GAG
gttcttcctcccgcaccaca

SEQ ID NO: 12739 - DNA, 20 bp, Artificial Sequence
  Description of Artificial Sequence: Synthetic oligonucleotide
  Target: AGXT; (+) strand; PAM type: NRG; PAM sequence: AGG
ttcttcctcccgcaccacag

SEQ ID NO: 12740 - DNA, 20 bp, Artificial Sequence
  Description of Artificial Sequence: Synthetic oligonucleotide
  Target: AGXT; (+) strand; PAM type: NRG; PAM sequence: GGG
tcttcctcccgcaccacaga

SEQ ID NO: 12741 - DNA, 20 bp, Artificial Sequence
  Description of Artificial Sequence: Synthetic oligonucleotide
  Target: AGXT; (+) strand; PAM type: NRG; PAM sequence: CGG
tcctcccgcaccacagaggg

SEQ ID NO: 12742 - DNA, 20 bp, Artificial Sequence
  Description of Artificial Sequence: Synthetic oligonucleotide
  Target: AGXT; (+) strand; PAM type: NRG; PAM sequence: GGG
cctcccgcaccacagagggc

SEQ ID NO: 12743 - DNA, 20 bp, Artificial Sequence
  Description of Artificial Sequence: Synthetic oligonucleotide
  Target: AGXT; (+) strand; PAM type: NRG; PAM sequence: GGG
ctcccgcaccacagagggcg

SEQ ID NO: 12744 - DNA, 20 bp, Artificial Sequence
  Description of Artificial Sequence: Synthetic oligonucleotide
  Target: AGXT; (+) strand; PAM type: NRG; PAM sequence: CAG
ccacccatgtcactgcccac

SEQ ID NO: 12745 - DNA, 20 bp, Artificial Sequence
  Description of Artificial Sequence: Synthetic oligonucleotide
  Target: AGXT; (+) strand; PAM type: NRG; PAM sequence: CAG
caccagcgccatctcccaca

SEQ ID NO: 12746 - DNA, 20 bp, Artificial Sequence
  Description of Artificial Sequence: Synthetic oligonucleotide
  Target: AGXT; (+) strand; PAM type: NRG; PAM sequence: AGG
accagcgccatctcccacac

SEQ ID NO: 12747 - DNA, 20 bp, Artificial Sequence
  Description of Artificial Sequence: Synthetic oligonucleotide
  Target: AGXT; (+) strand; PAM type: NRG; PAM sequence: GGG
ccagcgccatctcccacaca

SEQ ID NO: 12748 - DNA, 20 bp, Artificial Sequence
  Description of Artificial Sequence: Synthetic oligonucleotide
  Target: AGXT; (+) strand; PAM type: NRG; PAM sequence: TGG
gccatctcccacacagggcc

SEQ ID NO: 12749 - DNA, 20 bp, Artificial Sequence
  Description of Artificial Sequence: Synthetic oligonucleotide
  Target: AGXT; (+) strand; PAM type: NRG; PAM sequence: GAG
catctcccacacagggcctg

SEQ ID NO: 12750 - DNA, 20 bp, Artificial Sequence
  Description of Artificial Sequence: Synthetic oligonucleotide
  Target: AGXT; (+) strand; PAM type: NRG; PAM sequence: CAG
cccacacagggcctggagaa

SEQ ID NO: 12751 - DNA, 20 bp, Artificial Sequence
  Description of Artificial Sequence: Synthetic oligonucleotide
  Target: AGXT; (+) strand; PAM type: NRG; PAM sequence: TGG
cacagggcctggagaacagc

SEQ ID NO: 12752 - DNA, 20 bp, Artificial Sequence
  Description of Artificial Sequence: Synthetic oligonucleotide
  Target: AGXT; (+) strand; PAM type: NRG; PAM sequence: CAG
gcctggagaacagctggcgc

SEQ ID NO: 12753 - DNA, 20 bp, Artificial Sequence
  Description of Artificial Sequence: Synthetic oligonucleotide
  Target: AGXT; (+) strand; PAM type: NRG; PAM sequence: GAG
acagctggcgccagcaccgc

SEQ ID NO: 12754 - DNA, 20 bp, Artificial Sequence
  Description of Artificial Sequence: Synthetic oligonucleotide
  Target: AGXT; (+) strand; PAM type: NRG; PAM sequence: AGG
cagctggcgccagcaccgcg

SEQ ID NO: 12755 - DNA, 20 bp, Artificial Sequence
  Description of Artificial Sequence: Synthetic oligonucleotide
  Target: AGXT; (+) strand; PAM type: NRG; PAM sequence: CGG
gcgccagcaccgcgaggccg

SEQ ID NO: 12756 - DNA, 20 bp, Artificial Sequence
  Description of Artificial Sequence: Synthetic oligonucleotide
  Target: AGXT; (+) strand; PAM type: NRG; PAM sequence: TGG
gaggccgcggcgtatctgca

SEQ ID NO: 12757 - DNA, 20 bp, Artificial Sequence
  Description of Artificial Sequence: Synthetic oligonucleotide
  Target: AGXT; (+) strand; PAM type: NRG; PAM sequence: GGG
aggccgcggcgtatctgcat

SEQ ID NO: 12758 - DNA, 20 bp, Artificial Sequence
  Description of Artificial Sequence: Synthetic oligonucleotide
  Target: AGXT; (+) strand; PAM type: NRG; PAM sequence: CAG
cgtatctgcatgggcgcctg

SEQ ID NO: 12759 - DNA, 20 bp, Artificial Sequence
  Description of Artificial Sequence: Synthetic oligonucleotide
  Target: AGXT; (+) strand; PAM type: NRG; PAM sequence: AGG
gtatctgcatgggcgcctgc

SEQ ID NO: 12760 - DNA, 20 bp, Artificial Sequence
  Description of Artificial Sequence: Synthetic oligonucleotide
  Target: AGXT; (+) strand; PAM type: NRG; PAM sequence: TGG
gcatgggcgcctgcaggcac

SEQ ID NO: 12761 - DNA, 20 bp, Artificial Sequence
  Description of Artificial Sequence: Synthetic oligonucleotide
  Target: AGXT; (+) strand; PAM type: NRG; PAM sequence: GGG
catgggcgcctgcaggcact

SEQ ID NO: 12762 - DNA, 20 bp, Artificial Sequence
  Description of Artificial Sequence: Synthetic oligonucleotide
  Target: AGXT; (+) strand; PAM type: NRG; PAM sequence: GGG
atgggcgcctgcaggcactg

SEQ ID NO: 12763 - DNA, 20 bp, Artificial Sequence
  Description of Artificial Sequence: Synthetic oligonucleotide
  Target: AGXT; (+) strand; PAM type: NRG; PAM sequence: CAG
gcctgcaggcactggggctg

SEQ ID NO: 12764 - DNA, 20 bp, Artificial Sequence
  Description of Artificial Sequence: Synthetic oligonucleotide
  Target: AGXT; (+) strand; PAM type: NRG; PAM sequence: AAG
tggggctgcagctcttcgtg

SEQ ID NO: 12765 - DNA, 20 bp, Artificial Sequence
  Description of Artificial Sequence: Synthetic oligonucleotide
  Target: AGXT; (+) strand; PAM type: NRG; PAM sequence: AGG
ggggctgcagctcttcgtga

SEQ ID NO: 12766 - DNA, 20 bp, Artificial Sequence
  Description of Artificial Sequence: Synthetic oligonucleotide
  Target: AGXT; (+) strand; PAM type: NRG; PAM sequence: CGG
gcagctcttcgtgaaggacc

SEQ ID NO: 12767 - DNA, 20 bp, Artificial Sequence
  Description of Artificial Sequence: Synthetic oligonucleotide
  Target: AGXT; (+) strand; PAM type: NRG; PAM sequence: AAG
ctcttcgtgaaggacccggt

SEQ ID NO: 12768 - DNA, 20 bp, Artificial Sequence
  Description of Artificial Sequence: Synthetic oligonucleotide
  Target: AGXT; (+) strand; PAM type: NRG; PAM sequence: AGG
tcttcgtgaaggacccggta

SEQ ID NO: 12769 - DNA, 20 bp, Artificial Sequence
  Description of Artificial Sequence: Synthetic oligonucleotide
  Target: AGXT; (+) strand; PAM type: NRG; PAM sequence: GAG
ttcgtgaaggacccggtaag

SEQ ID NO: 12770 - DNA, 20 bp, Artificial Sequence
  Description of Artificial Sequence: Synthetic oligonucleotide
  Target: AGXT; (+) strand; PAM type: NRG; PAM sequence: AGG
tcgtgaaggacccggtaagg

SEQ ID NO: 12771 - DNA, 20 bp, Artificial Sequence
  Description of Artificial Sequence: Synthetic oligonucleotide
  Target: AGXT; (+) strand; PAM type: NRG; PAM sequence: TGG
ggacccggtaaggaggcccc

SEQ ID NO: 12772 - DNA, 20 bp, Artificial Sequence
  Description of Artificial Sequence: Synthetic oligonucleotide
  Target: AGXT; (+) strand; PAM type: NRG; PAM sequence: TGG
ggtaaggaggcccctggcat

SEQ ID NO: 12773 - DNA, 20 bp, Artificial Sequence
  Description of Artificial Sequence: Synthetic oligonucleotide
  Target: AGXT; (+) strand; PAM type: NRG; PAM sequence: GGG
gtaaggaggcccctggcatt

SEQ ID NO: 12774 - DNA, 20 bp, Artificial Sequence
  Description of Artificial Sequence: Synthetic oligonucleotide
  Target: AGXT; (+) strand; PAM type: NRG; PAM sequence: CAG
aggaggcccctggcattggg

SEQ ID NO: 12775 - DNA, 20 bp, Artificial Sequence
  Description of Artificial Sequence: Synthetic oligonucleotide
  Target: AGXT; (+) strand; PAM type: NRG; PAM sequence: TGG
attgggcagccctgcaccca

SEQ ID NO: 12776 - DNA, 20 bp, Artificial Sequence
  Description of Artificial Sequence: Synthetic oligonucleotide
  Target: AGXT; (+) strand; PAM type: NRG; PAM sequence: GGG
ttgggcagccctgcacccat

SEQ ID NO: 12777 - DNA, 20 bp, Artificial Sequence
  Description of Artificial Sequence: Synthetic oligonucleotide
  Target: AGXT; (+) strand; PAM type: NRG; PAM sequence: GGG
tgggcagccctgcacccatg

SEQ ID NO: 12778 - DNA, 20 bp, Artificial Sequence
  Description of Artificial Sequence: Synthetic oligonucleotide
  Target: AGXT; (+) strand; PAM type: NRG; PAM sequence: AAG
gcagccctgcacccatgggg

SEQ ID NO: 12779 - DNA, 20 bp, Artificial Sequence
  Description of Artificial Sequence: Synthetic oligonucleotide
  Target: AGXT; (+) strand; PAM type: NRG; PAM sequence: AGG
cagccctgcacccatgggga

SEQ ID NO: 12780 - DNA, 20 bp, Artificial Sequence
  Description of Artificial Sequence: Synthetic oligonucleotide
  Target: AGXT; (+) strand; PAM type: NRG; PAM sequence: GAG
ctgcacccatggggaaggat

SEQ ID NO: 12781 - DNA, 20 bp, Artificial Sequence
  Description of Artificial Sequence: Synthetic oligonucleotide
  Target: AGXT; (+) strand; PAM type: NRG; PAM sequence: AGG
tgcacccatggggaaggatg

SEQ ID NO: 12782 - DNA, 20 bp, Artificial Sequence
  Description of Artificial Sequence: Synthetic oligonucleotide
  Target: AGXT; (+) strand; PAM type: NRG; PAM sequence: GGG
gcacccatggggaaggatga

SEQ ID NO: 12783 - DNA, 20 bp, Artificial Sequence
  Description of Artificial Sequence: Synthetic oligonucleotide
  Target: AGXT; (+) strand; PAM type: NRG; PAM sequence: GGG
cacccatggggaaggatgag

SEQ ID NO: 12784 - DNA, 20 bp, Artificial Sequence
  Description of Artificial Sequence: Synthetic oligonucleotide
  Target: AGXT; (+) strand; PAM type: NRG; PAM sequence: CAG
aaggatgaggggctcttgcc

SEQ ID NO: 12785 - DNA, 20 bp, Artificial Sequence
  Description of Artificial Sequence: Synthetic oligonucleotide
  Target: AGXT; (+) strand; PAM type: NRG; PAM sequence: AAG
ggctcttgcccagccccctc

SEQ ID NO: 12786 - DNA, 20 bp, Artificial Sequence
  Description of Artificial Sequence: Synthetic oligonucleotide
  Target: AGXT; (+) strand; PAM type: NRG; PAM sequence: GAG
ctcttgcccagccccctcaa

SEQ ID NO: 12787 - DNA, 20 bp, Artificial Sequence
  Description of Artificial Sequence: Synthetic oligonucleotide
  Target: AGXT; (+) strand; PAM type: NRG; PAM sequence: AGG
tcttgcccagccccctcaag

SEQ ID NO: 12788 - DNA, 20 bp, Artificial Sequence
  Description of Artificial Sequence: Synthetic oligonucleotide
  Target: AGXT; (+) strand; PAM type: NRG; PAM sequence: GGG
cttgcccagccccctcaaga

SEQ ID NO: 12789 - DNA, 20 bp, Artificial Sequence
  Description of Artificial Sequence: Synthetic oligonucleotide
  Target: AGXT; (+) strand; PAM type: NRG; PAM sequence: TGG
agccccctcaagagggacac

SEQ ID NO: 12790 - DNA, 20 bp, Artificial Sequence
  Description of Artificial Sequence: Synthetic oligonucleotide
  Target: AGXT; (+) strand; PAM type: NRG; PAM sequence: GAG
caagagggacactggctcct

SEQ ID NO: 12791 - DNA, 20 bp, Artificial Sequence
  Description of Artificial Sequence: Synthetic oligonucleotide
  Target: AGXT; (+) strand; PAM type: NRG; PAM sequence: AAG
gagggacactggctcctgag

SEQ ID NO: 12792 - DNA, 20 bp, Artificial Sequence
  Description of Artificial Sequence: Synthetic oligonucleotide
  Target: AGXT; (+) strand; PAM type: NRG; PAM sequence: AGG
agggacactggctcctgaga

SEQ ID NO: 12793 - DNA, 20 bp, Artificial Sequence
  Description of Artificial Sequence: Synthetic oligonucleotide
  Target: AGXT; (+) strand; PAM type: NRG; PAM sequence: GAG
ggacactggctcctgagaag

SEQ ID NO: 12794 - DNA, 20 bp, Artificial Sequence
  Description of Artificial Sequence: Synthetic oligonucleotide
  Target: AGXT; (+) strand; PAM type: NRG; PAM sequence: AGG
gacactggctcctgagaagg

SEQ ID NO: 12795 - DNA, 20 bp, Artificial Sequence
  Description of Artificial Sequence: Synthetic oligonucleotide
  Target: AGXT; (+) strand; PAM type: NRG; PAM sequence: GGG
acactggctcctgagaagga

SEQ ID NO: 12796 - DNA, 20 bp, Artificial Sequence
  Description of Artificial Sequence: Synthetic oligonucleotide
  Target: AGXT; (+) strand; PAM type: NRG; PAM sequence: GGG
cactggctcctgagaaggag

SEQ ID NO: 12797 - DNA, 20 bp, Artificial Sequence
  Description of Artificial Sequence: Synthetic oligonucleotide
  Target: AGXT; (+) strand; PAM type: NRG; PAM sequence: GGG
actggctcctgagaaggagg

SEQ ID NO: 12798 - DNA, 20 bp, Artificial Sequence
  Description of Artificial Sequence: Synthetic oligonucleotide
  Target: AGXT; (+) strand; PAM type: NRG; PAM sequence: CGG
ggctcctgagaaggaggggg

SEQ ID NO: 12799 - DNA, 20 bp, Artificial Sequence
  Description of Artificial Sequence: Synthetic oligonucleotide
  Target: AGXT; (+) strand; PAM type: NRG; PAM sequence: CGG
agaaggagggggcggctgcc

SEQ ID NO: 12800 - DNA, 20 bp, Artificial Sequence
  Description of Artificial Sequence: Synthetic oligonucleotide
  Target: AGXT; (+) strand; PAM type: NRG; PAM sequence: TGG
aggagggggcggctgcccgg

SEQ ID NO: 12801 - DNA, 20 bp, Artificial Sequence
  Description of Artificial Sequence: Synthetic oligonucleotide
  Target: AGXT; (+) strand; PAM type: NRG; PAM sequence: TGG
ggggcggctgcccggtggtg

SEQ ID NO: 12802 - DNA, 20 bp, Artificial Sequence
  Description of Artificial Sequence: Synthetic oligonucleotide
  Target: AGXT; (+) strand; PAM type: NRG; PAM sequence: CGG
gctgcccggtggtgtggcct

SEQ ID NO: 12803 - DNA, 20 bp, Artificial Sequence
  Description of Artificial Sequence: Synthetic oligonucleotide
  Target: AGXT; (+) strand; PAM type: NRG; PAM sequence: CAG
cggtggtgtggcctcggtgc

SEQ ID NO: 12804 - DNA, 20 bp, Artificial Sequence
  Description of Artificial Sequence: Synthetic oligonucleotide
  Target: AGXT; (+) strand; PAM type: NRG; PAM sequence: AGG
ggtggtgtggcctcggtgcc

SEQ ID NO: 12805 - DNA, 20 bp, Artificial Sequence
  Description of Artificial Sequence: Synthetic oligonucleotide
  Target: AGXT; (+) strand; PAM type: NRG; PAM sequence: GGG
gtggtgtggcctcggtgcca

SEQ ID NO: 12806 - DNA, 20 bp, Artificial Sequence
  Description of Artificial Sequence: Synthetic oligonucleotide
  Target: AGXT; (+) strand; PAM type: NRG; PAM sequence: TAG
gtggcctcggtgccagggat

SEQ ID NO: 12807 - DNA, 20 bp, Artificial Sequence
  Description of Artificial Sequence: Synthetic oligonucleotide
  Target: AGXT; (+) strand; PAM type: NRG; PAM sequence: CGG
tcggtgccagggattagtct

SEQ ID NO: 12808 - DNA, 20 bp, Artificial Sequence
  Description of Artificial Sequence: Synthetic oligonucleotide
  Target: AGXT; (+) strand; PAM type: NRG; PAM sequence: CAG
gtgccagggattagtctcgg

SEQ ID NO: 12809 - DNA, 20 bp, Artificial Sequence
  Description of Artificial Sequence: Synthetic oligonucleotide
  Target: AGXT; (+) strand; PAM type: NRG; PAM sequence: AGG
tgccagggattagtctcggc

SEQ ID NO: 12810 - DNA, 20 bp, Artificial Sequence
  Description of Artificial Sequence: Synthetic oligonucleotide
  Target: AGXT; (+) strand; PAM type: NRG; PAM sequence: GAG
ccagggattagtctcggcag

SEQ ID NO: 12811 - DNA, 20 bp, Artificial Sequence
  Description of Artificial Sequence: Synthetic oligonucleotide
  Target: AGXT; (+) strand; PAM type: NRG; PAM sequence: AAG
tagtctcggcaggagccacg

SEQ ID NO: 12812 - DNA, 20 bp, Artificial Sequence
  Description of Artificial Sequence: Synthetic oligonucleotide
  Target: AGXT; (+) strand; PAM type: NRG; PAM sequence: CAG
cggcaggagccacgaagtca

SEQ ID NO: 12813 - DNA, 20 bp, Artificial Sequence
  Description of Artificial Sequence: Synthetic oligonucleotide
  Target: AGXT; (+) strand; PAM type: NRG; PAM sequence: CGG
agccacgaagtcacagctcc

SEQ ID NO: 12814 - DNA, 20 bp, Artificial Sequence
  Description of Artificial Sequence: Synthetic oligonucleotide
  Target: AGXT; (+) strand; PAM type: NRG; PAM sequence: CGG
acagctcccggcctctgatg

SEQ ID NO: 12815 - DNA, 20 bp, Artificial Sequence
  Description of Artificial Sequence: Synthetic oligonucleotide
  Target: AGXT; (+) strand; PAM type: NRG; PAM sequence: GGG
cagctcccggcctctgatgc

SEQ ID NO: 12816 - DNA, 20 bp, Artificial Sequence
  Description of Artificial Sequence: Synthetic oligonucleotide
  Target: AGXT; (+) strand; PAM type: NRG; PAM sequence: CAG
cggcctctgatgcgggatct

SEQ ID NO: 12817 - DNA, 20 bp, Artificial Sequence
  Description of Artificial Sequence: Synthetic oligonucleotide
  Target: AGXT; (+) strand; PAM type: NRG; PAM sequence: AGG
ggcctctgatgcgggatctc

SEQ ID NO: 12818 - DNA, 20 bp, Artificial Sequence
  Description of Artificial Sequence: Synthetic oligonucleotide
  Target: AGXT; (+) strand; PAM type: NRG; PAM sequence: CGG
tctgatgcgggatctcagga

SEQ ID NO: 12819 - DNA, 20 bp, Artificial Sequence
  Description of Artificial Sequence: Synthetic oligonucleotide
  Target: AGXT; (+) strand; PAM type: NRG; PAM sequence: CAG
caggacggcctgtgatctcc

SEQ ID NO: 12820 - DNA, 20 bp, Artificial Sequence
  Description of Artificial Sequence: Synthetic oligonucleotide
  Target: AGXT; (+) strand; PAM type: NRG; PAM sequence: TGG
gacggcctgtgatctcccag

SEQ ID NO: 12821 - DNA, 20 bp, Artificial Sequence
  Description of Artificial Sequence: Synthetic oligonucleotide
  Target: AGXT; (+) strand; PAM type: NRG; PAM sequence: GGG
acggcctgtgatctcccagt

SEQ ID NO: 12822 - DNA, 20 bp, Artificial Sequence
  Description of Artificial Sequence: Synthetic oligonucleotide
  Target: AGXT; (+) strand; PAM type: NRG; PAM sequence: AAG
gcctgtgatctcccagtggg

SEQ ID NO: 12823 - DNA, 20 bp, Artificial Sequence
  Description of Artificial Sequence: Synthetic oligonucleotide
  Target: AGXT; (+) strand; PAM type: NRG; PAM sequence: AGG
cctgtgatctcccagtggga

SEQ ID NO: 12824 - DNA, 20 bp, Artificial Sequence
  Description of Artificial Sequence: Synthetic oligonucleotide
  Target: AGXT; (+) strand; PAM type: NRG; PAM sequence: AAG
gtgcccatccaccgcctcct

SEQ ID NO: 12825 - DNA, 20 bp, Artificial Sequence
  Description of Artificial Sequence: Synthetic oligonucleotide
  Target: AGXT; (+) strand; PAM type: NRG; PAM sequence: AGG
tgcccatccaccgcctccta

SEQ ID NO: 12826 - DNA, 20 bp, Artificial Sequence
  Description of Artificial Sequence: Synthetic oligonucleotide
  Target: AGXT; (+) strand; PAM type: NRG; PAM sequence: GGG
gcccatccaccgcctcctaa

SEQ ID NO: 12827 - DNA, 20 bp, Artificial Sequence
  Description of Artificial Sequence: Synthetic oligonucleotide
  Target: AGXT; (+) strand; PAM type: NRG; PAM sequence: GGG
cccatccaccgcctcctaag

SEQ ID NO: 12828 - DNA, 20 bp, Artificial Sequence
  Description of Artificial Sequence: Synthetic oligonucleotide
  Target: AGXT; (+) strand; PAM type: NRG; PAM sequence: TGG
atccaccgcctcctaagggg

SEQ ID NO: 12829 - DNA, 20 bp, Artificial Sequence
  Description of Artificial Sequence: Synthetic oligonucleotide
  Target: AGXT; (+) strand; PAM type: NRG; PAM sequence: GGG
tccaccgcctcctaaggggt

SEQ ID NO: 12830 - DNA, 20 bp, Artificial Sequence
  Description of Artificial Sequence: Synthetic oligonucleotide
  Target: AGXT; (+) strand; PAM type: NRG; PAM sequence: GGG
ccaccgcctcctaaggggtg

SEQ ID NO: 12831 - DNA, 20 bp, Artificial Sequence
  Description of Artificial Sequence: Synthetic oligonucleotide
  Target: AGXT; (+) strand; PAM type: NRG; PAM sequence: CGG
gtggggtccctgctctctcc

SEQ ID NO: 12832 - DNA, 20 bp, Artificial Sequence
  Description of Artificial Sequence: Synthetic oligonucleotide
  Target: AGXT; (+) strand; PAM type: NRG; PAM sequence: CGG
tctcccggccctttctcccc

SEQ ID NO: 12833 - DNA, 20 bp, Artificial Sequence
  Description of Artificial Sequence: Synthetic oligonucleotide
  Target: AGXT; (+) strand; PAM type: NRG; PAM sequence: TGG
cctttctcccccggctcctc

SEQ ID NO: 12834 - DNA, 20 bp, Artificial Sequence
  Description of Artificial Sequence: Synthetic oligonucleotide
  Target: AGXT; (+) strand; PAM type: NRG; PAM sequence: AAG
cccggctcctctggaacctg

SEQ ID NO: 12835 - DNA, 20 bp, Artificial Sequence
  Description of Artificial Sequence: Synthetic oligonucleotide
  Target: AGXT; (+) strand; PAM type: NRG; PAM sequence: TGG
gctcctctggaacctgaagc

SEQ ID NO: 12836 - DNA, 20 bp, Artificial Sequence
  Description of Artificial Sequence: Synthetic oligonucleotide
  Target: AGXT; (+) strand; PAM type: NRG; PAM sequence: GGG
ctcctctggaacctgaagct

SEQ ID NO: 12837 - DNA, 20 bp, Artificial Sequence
  Description of Artificial Sequence: Synthetic oligonucleotide
  Target: AGXT; (+) strand; PAM type: NRG; PAM sequence: GGG
tcctctggaacctgaagctg

SEQ ID NO: 12838 - DNA, 20 bp, Artificial Sequence
  Description of Artificial Sequence: Synthetic oligonucleotide
  Target: AGXT; (+) strand; PAM type: NRG; PAM sequence: CAG
tctggaacctgaagctgggg

SEQ ID NO: 12839 - DNA, 20 bp, Artificial Sequence
  Description of Artificial Sequence: Synthetic oligonucleotide
  Target: AGXT; (+) strand; PAM type: NRG; PAM sequence: TGG
gaacctgaagctggggcaga

SEQ ID NO: 12840 - DNA, 20 bp, Artificial Sequence
  Description of Artificial Sequence: Synthetic oligonucleotide
  Target: AGXT; (+) strand; PAM type: NRG; PAM sequence: CAG
tgaagctggggcagatggtg

SEQ ID NO: 12841 - DNA, 20 bp, Artificial Sequence
  Description of Artificial Sequence: Synthetic oligonucleotide
  Target: AGXT; (+) strand; PAM type: NRG; PAM sequence: AGG
gaagctggggcagatggtgc

SEQ ID NO: 12842 - DNA, 20 bp, Artificial Sequence
  Description of Artificial Sequence: Synthetic oligonucleotide
  Target: AGXT; (+) strand; PAM type: NRG; PAM sequence: AAG
tggggcagatggtgcaggcc

SEQ ID NO: 12843 - DNA, 20 bp, Artificial Sequence
  Description of Artificial Sequence: Synthetic oligonucleotide
  Target: AGXT; (+) strand; PAM type: NRG; PAM sequence: GAG
gggcagatggtgcaggccaa

SEQ ID NO: 12844 - DNA, 20 bp, Artificial Sequence
  Description of Artificial Sequence: Synthetic oligonucleotide
  Target: AGXT; (+) strand; PAM type: NRG; PAM sequence: AAG
gcaggccaagagctgtcaca

SEQ ID NO: 12845 - DNA, 20 bp, Artificial Sequence
  Description of Artificial Sequence: Synthetic oligonucleotide
  Target: AGXT; (+) strand; PAM type: NRG; PAM sequence: AGG
caggccaagagctgtcacaa

SEQ ID NO: 12846 - DNA, 20 bp, Artificial Sequence
  Description of Artificial Sequence: Synthetic oligonucleotide
  Target: AGXT; (+) strand; PAM type: NRG; PAM sequence: CAG
agctgtcacaaaggcccgta

SEQ ID NO: 12847 - DNA, 20 bp, Artificial Sequence
  Description of Artificial Sequence: Synthetic oligonucleotide
  Target: AGXT; (+) strand; PAM type: NRG; PAM sequence: AGG
gctgtcacaaaggcccgtac

SEQ ID NO: 12848 - DNA, 20 bp, Artificial Sequence
  Description of Artificial Sequence: Synthetic oligonucleotide
  Target: AGXT; (+) strand; PAM type: NRG; PAM sequence: GGG
ctgtcacaaaggcccgtaca

SEQ ID NO: 12849 - DNA, 20 bp, Artificial Sequence
  Description of Artificial Sequence: Synthetic oligonucleotide
  Target: AGXT; (+) strand; PAM type: NRG; PAM sequence: GAG
gggcctctcacccacgcact

SEQ ID NO: 12850 - DNA, 20 bp, Artificial Sequence
  Description of Artificial Sequence: Synthetic oligonucleotide
  Target: AGXT; (+) strand; PAM type: NRG; PAM sequence: CAG
ctctcacccacgcactgagc

SEQ ID NO: 12851 - DNA, 20 bp, Artificial Sequence
  Description of Artificial Sequence: Synthetic oligonucleotide
  Target: AGXT; (+) strand; PAM type: NRG; PAM sequence: AGG
tctcacccacgcactgagcc

SEQ ID NO: 12852 - DNA, 20 bp, Artificial Sequence
  Description of Artificial Sequence: Synthetic oligonucleotide
  Target: AGXT; (+) strand; PAM type: NRG; PAM sequence: CAG
actgagccaggcccctcctg

SEQ ID NO: 12853 - DNA, 20 bp, Artificial Sequence
  Description of Artificial Sequence: Synthetic oligonucleotide
  Target: AGXT; (+) strand; PAM type: NRG; PAM sequence: AGG
ctgagccaggcccctcctgc

SEQ ID NO: 12854 - DNA, 20 bp, Artificial Sequence
  Description of Artificial Sequence: Synthetic oligonucleotide
  Target: AGXT; (+) strand; PAM type: NRG; PAM sequence: CGG
ggcccctcctgcaggcgctc

SEQ ID NO: 12855 - DNA, 20 bp, Artificial Sequence
  Description of Artificial Sequence: Synthetic oligonucleotide
  Target: AGXT; (+) strand; PAM type: NRG; PAM sequence: CAG
gcaggcgctccggcttccca

SEQ ID NO: 12856 - DNA, 20 bp, Artificial Sequence
  Description of Artificial Sequence: Synthetic oligonucleotide
  Target: AGXT; (+) strand; PAM type: NRG; PAM sequence: TGG
gcttcccacagtcaccactg

SEQ ID NO: 12857 - DNA, 20 bp, Artificial Sequence
  Description of Artificial Sequence: Synthetic oligonucleotide
  Target: AGXT; (+) strand; PAM type: NRG; PAM sequence: TGG
accactgtggctgtacccgc

SEQ ID NO: 12858 - DNA, 20 bp, Artificial Sequence
  Description of Artificial Sequence: Synthetic oligonucleotide
  Target: AGXT; (+) strand; PAM type: NRG; PAM sequence: TGG
ctgtacccgctggctatgac

SEQ ID NO: 12859 - DNA, 20 bp, Artificial Sequence
  Description of Artificial Sequence: Synthetic oligonucleotide
  Target: AGXT; (+) strand; PAM type: NRG; PAM sequence: GAG
gtacccgctggctatgactg

SEQ ID NO: 12860 - DNA, 20 bp, Artificial Sequence
  Description of Artificial Sequence: Synthetic oligonucleotide
  Target: AGXT; (+) strand; PAM type: NRG; PAM sequence: GAG
acccgctggctatgactgga

SEQ ID NO: 12861 - DNA, 20 bp, Artificial Sequence
  Description of Artificial Sequence: Synthetic oligonucleotide
  Target: AGXT; (+) strand; PAM type: NRG; PAM sequence: CAG
tatgactggagagacatcgt

SEQ ID NO: 12862 - DNA, 20 bp, Artificial Sequence
  Description of Artificial Sequence: Synthetic oligonucleotide
  Target: AGXT; (+) strand; PAM type: NRG; PAM sequence: TAG
agacatcgtcagctacgtca

SEQ ID NO: 12863 - DNA, 20 bp, Artificial Sequence
  Description of Artificial Sequence: Synthetic oligonucleotide
  Target: AGXT; (+) strand; PAM type: NRG; PAM sequence: GAG
tcatagaccacttcgacatt

SEQ ID NO: 12864 - DNA, 20 bp, Artificial Sequence
  Description of Artificial Sequence: Synthetic oligonucleotide
  Target: AGXT; (+) strand; PAM type: NRG; PAM sequence: TGG
ccacttcgacattgagatca

SEQ ID NO: 12865 - DNA, 20 bp, Artificial Sequence
  Description of Artificial Sequence: Synthetic oligonucleotide
  Target: AGXT; (+) strand; PAM type: NRG; PAM sequence: GGG
cacttcgacattgagatcat

SEQ ID NO: 12866 - DNA, 20 bp, Artificial Sequence
  Description of Artificial Sequence: Synthetic oligonucleotide
  Target: AGXT; (+) strand; PAM type: NRG; PAM sequence: TGG
ttcgacattgagatcatggg

SEQ ID NO: 12867 - DNA, 20 bp, Artificial Sequence
  Description of Artificial Sequence: Synthetic oligonucleotide
  Target: AGXT; (+) strand; PAM type: NRG; PAM sequence: TGG
attgagatcatgggtggcct

SEQ ID NO: 12868 - DNA, 20 bp, Artificial Sequence
  Description of Artificial Sequence: Synthetic oligonucleotide
  Target: AGXT; (+) strand; PAM type: NRG; PAM sequence: GGG
ttgagatcatgggtggcctt

SEQ ID NO: 12869 - DNA, 20 bp, Artificial Sequence
  Description of Artificial Sequence: Synthetic oligonucleotide
  Target: AGXT; (+) strand; PAM type: NRG; PAM sequence: CGG
gggtggccttgggccctcca

SEQ ID NO: 12870 - DNA, 20 bp, Artificial Sequence
  Description of Artificial Sequence: Synthetic oligonucleotide
  Target: AGXT; (+) strand; PAM type: NRG; PAM sequence: GGG
ggtggccttgggccctccac

SEQ ID NO: 12871 - DNA, 20 bp, Artificial Sequence
  Description of Artificial Sequence: Synthetic oligonucleotide
  Target: AGXT; (+) strand; PAM type: NRG; PAM sequence: GGG
gtggccttgggccctccacg

SEQ ID NO: 12872 - DNA, 20 bp, Artificial Sequence
  Description of Artificial Sequence: Synthetic oligonucleotide
  Target: AGXT; (+) strand; PAM type: NRG; PAM sequence: AAG
gccttgggccctccacgggg

SEQ ID NO: 12873 - DNA, 20 bp, Artificial Sequence
  Description of Artificial Sequence: Synthetic oligonucleotide
  Target: AGXT; (+) strand; PAM type: NRG; PAM sequence: AGG
ccttgggccctccacgggga

SEQ ID NO: 12874 - DNA, 20 bp, Artificial Sequence
  Description of Artificial Sequence: Synthetic oligonucleotide
  Target: AGXT; (+) strand; PAM type: NRG; PAM sequence: GAG
gggccctccacggggaaggt

SEQ ID NO: 12875 - DNA, 20 bp, Artificial Sequence
  Description of Artificial Sequence: Synthetic oligonucleotide
  Target: AGXT; (+) strand; PAM type: NRG; PAM sequence: GAG
gccctccacggggaaggtga

SEQ ID NO: 12876 - DNA, 20 bp, Artificial Sequence
  Description of Artificial Sequence: Synthetic oligonucleotide
  Target: AGXT; (+) strand; PAM type: NRG; PAM sequence: AGG
ccctccacggggaaggtgag

SEQ ID NO: 12877 - DNA, 20 bp, Artificial Sequence
  Description of Artificial Sequence: Synthetic oligonucleotide
  Target: AGXT; (+) strand; PAM type: NRG; PAM sequence: GGG
cctccacggggaaggtgaga

SEQ ID NO: 12878 - DNA, 20 bp, Artificial Sequence
  Description of Artificial Sequence: Synthetic oligonucleotide
  Target: AGXT; (+) strand; PAM type: NRG; PAM sequence: GAG
tccacggggaaggtgagagg

SEQ ID NO: 12879 - DNA, 20 bp, Artificial Sequence
  Description of Artificial Sequence: Synthetic oligonucleotide
  Target: AGXT; (+) strand; PAM type: NRG; PAM sequence: GAG
aaggtgagagggagcgcctc

SEQ ID NO: 12880 - DNA, 20 bp, Artificial Sequence
  Description of Artificial Sequence: Synthetic oligonucleotide
  Target: AGXT; (+) strand; PAM type: NRG; PAM sequence: AGG
aggtgagagggagcgcctcg

SEQ ID NO: 12881 - DNA, 20 bp, Artificial Sequence
  Description of Artificial Sequence: Synthetic oligonucleotide
  Target: AGXT; (+) strand; PAM type: NRG; PAM sequence: GGG
ggtgagagggagcgcctcga

SEQ ID NO: 12882 - DNA, 20 bp, Artificial Sequence
  Description of Artificial Sequence: Synthetic oligonucleotide
  Target: AGXT; (+) strand; PAM type: NRG; PAM sequence: CAG
agcgcctcgagggccttttg

SEQ ID NO: 12883 - DNA, 20 bp, Artificial Sequence
  Description of Artificial Sequence: Synthetic oligonucleotide
  Target: AGXT; (+) strand; PAM type: NRG; PAM sequence: GAG
caaacccgccacccctcctt

SEQ ID NO: 12884 - DNA, 20 bp, Artificial Sequence
  Description of Artificial Sequence: Synthetic oligonucleotide
  Target: AGXT; (+) strand; PAM type: NRG; PAM sequence: CAG
acccgccacccctccttgag

SEQ ID NO: 12885 - DNA, 20 bp, Artificial Sequence
  Description of Artificial Sequence: Synthetic oligonucleotide
  Target: AGXT; (+) strand; PAM type: NRG; PAM sequence: AGG
cccgccacccctccttgagc

SEQ ID NO: 12886 - DNA, 20 bp, Artificial Sequence
  Description of Artificial Sequence: Synthetic oligonucleotide
  Target: AGXT; (+) strand; PAM type: NRG; PAM sequence: CAG
ccttgagcaggactgtgcac

SEQ ID NO: 12887 - DNA, 20 bp, Artificial Sequence
  Description of Artificial Sequence: Synthetic oligonucleotide
  Target: AGXT; (+) strand; PAM type: NRG; PAM sequence: AGG
cttgagcaggactgtgcacc

SEQ ID NO: 12888 - DNA, 20 bp, Artificial Sequence
  Description of Artificial Sequence: Synthetic oligonucleotide
  Target: AGXT; (+) strand; PAM type: NRG; PAM sequence: CAG
gcaggactgtgcaccaggtg

SEQ ID NO: 12889 - DNA, 20 bp, Artificial Sequence
  Description of Artificial Sequence: Synthetic oligonucleotide
  Target: AGXT; (+) strand; PAM type: NRG; PAM sequence: AGG
caggactgtgcaccaggtgc

SEQ ID NO: 12890 - DNA, 20 bp, Artificial Sequence
  Description of Artificial Sequence: Synthetic oligonucleotide
  Target: AGXT; (+) strand; PAM type: NRG; PAM sequence: GGG
aggactgtgcaccaggtgca

SEQ ID NO: 12891 - DNA, 20 bp, Artificial Sequence
  Description of Artificial Sequence: Synthetic oligonucleotide
  Target: AGXT; (+) strand; PAM type: NRG; PAM sequence: GGG
ggactgtgcaccaggtgcag

SEQ ID NO: 12892 - DNA, 20 bp, Artificial Sequence
  Description of Artificial Sequence: Synthetic oligonucleotide
  Target: AGXT; (+) strand; PAM type: NRG; PAM sequence: GAG
actgtgcaccaggtgcaggg

SEQ ID NO: 12893 - DNA, 20 bp, Artificial Sequence
  Description of Artificial Sequence: Synthetic oligonucleotide
  Target: AGXT; (+) strand; PAM type: NRG; PAM sequence: AGG
ctgtgcaccaggtgcagggg

SEQ ID NO: 12894 - DNA, 20 bp, Artificial Sequence
  Description of Artificial Sequence: Synthetic oligonucleotide
  Target: AGXT; (+) strand; PAM type: NRG; PAM sequence: CGG
gcaccaggtgcaggggaggc

SEQ ID NO: 12895 - DNA, 20 bp, Artificial Sequence
  Description of Artificial Sequence: Synthetic oligonucleotide
  Target: AGXT; (+) strand; PAM type: NRG; PAM sequence: GGG
caccaggtgcaggggaggcc

SEQ ID NO: 12896 - DNA, 20 bp, Artificial Sequence
  Description of Artificial Sequence: Synthetic oligonucleotide
  Target: AGXT; (+) strand; PAM type: NRG; PAM sequence: GGG
accaggtgcaggggaggccg

SEQ ID NO: 12897 - DNA, 20 bp, Artificial Sequence
  Description of Artificial Sequence: Synthetic oligonucleotide
  Target: AGXT; (+) strand; PAM type: NRG; PAM sequence: AAG
gggaggccggggtcatccga

SEQ ID NO: 12898 - DNA, 20 bp, Artificial Sequence
  Description of Artificial Sequence: Synthetic oligonucleotide
  Target: AGXT; (+) strand; PAM type: NRG; PAM sequence: CAG
gccggggtcatccgaaagcc

SEQ ID NO: 12899 - DNA, 20 bp, Artificial Sequence
  Description of Artificial Sequence: Synthetic oligonucleotide
  Target: AGXT; (+) strand; PAM type: NRG; PAM sequence: CAG
tcatccgaaagcccagattg

SEQ ID NO: 12900 - DNA, 20 bp, Artificial Sequence
  Description of Artificial Sequence: Synthetic oligonucleotide
  Target: AGXT; (+) strand; PAM type: NRG; PAM sequence: AGG
catccgaaagcccagattgc

SEQ ID NO: 12901 - DNA, 20 bp, Artificial Sequence
  Description of Artificial Sequence: Synthetic oligonucleotide
  Target: AGXT; (+) strand; PAM type: NRG; PAM sequence: GAG
tccgaaagcccagattgcag

SEQ ID NO: 12902 - DNA, 20 bp, Artificial Sequence
  Description of Artificial Sequence: Synthetic oligonucleotide
  Target: AGXT; (+) strand; PAM type: NRG; PAM sequence: CAG
gcccagattgcaggagcgtc

SEQ ID NO: 12903 - DNA, 20 bp, Artificial Sequence
  Description of Artificial Sequence: Synthetic oligonucleotide
  Target: AGXT; (+) strand; PAM type: NRG; PAM sequence: AAG
cagattgcaggagcgtccag

SEQ ID NO: 12904 - DNA, 20 bp, Artificial Sequence
  Description of Artificial Sequence: Synthetic oligonucleotide
  Target: AGXT; (+) strand; PAM type: NRG; PAM sequence: AGG
agattgcaggagcgtccaga

SEQ ID NO: 12905 - DNA, 20 bp, Artificial Sequence
  Description of Artificial Sequence: Synthetic oligonucleotide
  Target: AGXT; (+) strand; PAM type: NRG; PAM sequence: GGG
gattgcaggagcgtccagaa

SEQ ID NO: 12906 - DNA, 20 bp, Artificial Sequence
  Description of Artificial Sequence: Synthetic oligonucleotide
  Target: AGXT; (+) strand; PAM type: NRG; PAM sequence: AAG
tccagaagggcccactctcc

SEQ ID NO: 12907 - DNA, 20 bp, Artificial Sequence
  Description of Artificial Sequence: Synthetic oligonucleotide
  Target: AGXT; (+) strand; PAM type: NRG; PAM sequence: AGG
ccagaagggcccactctcca

SEQ ID NO: 12908 - DNA, 20 bp, Artificial Sequence
  Description of Artificial Sequence: Synthetic oligonucleotide
  Target: AGXT; (+) strand; PAM type: NRG; PAM sequence: GGG
cagaagggcccactctccaa

SEQ ID NO: 12909 - DNA, 20 bp, Artificial Sequence
  Description of Artificial Sequence: Synthetic oligonucleotide
  Target: AGXT; (+) strand; PAM type: NRG; PAM sequence: GGG
agaagggcccactctccaag

SEQ ID NO: 12910 - DNA, 20 bp, Artificial Sequence
  Description of Artificial Sequence: Synthetic oligonucleotide
  Target: AGXT; (+) strand; PAM type: NRG; PAM sequence: CAG
cccactctccaaggggtatc

SEQ ID NO: 12911 - DNA, 20 bp, Artificial Sequence
  Description of Artificial Sequence: Synthetic oligonucleotide
  Target: AGXT; (+) strand; PAM type: NRG; PAM sequence: AAG
tctccaaggggtatccagta

SEQ ID NO: 12912 - DNA, 20 bp, Artificial Sequence
  Description of Artificial Sequence: Synthetic oligonucleotide
  Target: AGXT; (+) strand; PAM type: NRG; PAM sequence: CAG
tgtcgcccctgctcccaccc

SEQ ID NO: 12913 - DNA, 20 bp, Artificial Sequence
  Description of Artificial Sequence: Synthetic oligonucleotide
  Target: AGXT; (+) strand; PAM type: NRG; PAM sequence: GAG
tgctcccaccccagcccact

SEQ ID NO: 12914 - DNA, 20 bp, Artificial Sequence
  Description of Artificial Sequence: Synthetic oligonucleotide
  Target: AGXT; (+) strand; PAM type: NRG; PAM sequence: AGG
gctcccaccccagcccactg

SEQ ID NO: 12915 - DNA, 20 bp, Artificial Sequence
  Description of Artificial Sequence: Synthetic oligonucleotide
  Target: AGXT; (+) strand; PAM type: NRG; PAM sequence: CAG
ccccagcccactgaggtcac

SEQ ID NO: 12916 - DNA, 20 bp, Artificial Sequence
  Description of Artificial Sequence: Synthetic oligonucleotide
  Target: AGXT; (+) strand; PAM type: NRG; PAM sequence: AGG
cccagcccactgaggtcacc

SEQ ID NO: 12917 - DNA, 20 bp, Artificial Sequence
  Description of Artificial Sequence: Synthetic oligonucleotide
  Target: AGXT; (+) strand; PAM type: NRG; PAM sequence: CAG
cccactgaggtcaccaggtg

SEQ ID NO: 12918 - DNA, 20 bp, Artificial Sequence
  Description of Artificial Sequence: Synthetic oligonucleotide
  Target: AGXT; (+) strand; PAM type: NRG; PAM sequence: CGG
gcagcctttatgattccact

SEQ ID NO: 12919 - DNA, 20 bp, Artificial Sequence
  Description of Artificial Sequence: Synthetic oligonucleotide
  Target: AGXT; (+) strand; PAM type: NRG; PAM sequence: CAG
catccttccttccctctgac

SEQ ID NO: 12920 - DNA, 20 bp, Artificial Sequence
  Description of Artificial Sequence: Synthetic oligonucleotide
  Target: AGXT; (+) strand; PAM type: NRG; PAM sequence: TGG
ccttccctctgaccagaccc

SEQ ID NO: 12921 - DNA, 20 bp, Artificial Sequence
  Description of Artificial Sequence: Synthetic oligonucleotide
  Target: AGXT; (+) strand; PAM type: NRG; PAM sequence: CAG
ctctgaccagaccctggaac

SEQ ID NO: 12922 - DNA, 20 bp, Artificial Sequence
  Description of Artificial Sequence: Synthetic oligonucleotide
  Target: AGXT; (+) strand; PAM type: NRG; PAM sequence: AGG
tctgaccagaccctggaacc

SEQ ID NO: 12923 - DNA, 20 bp, Artificial Sequence
  Description of Artificial Sequence: Synthetic oligonucleotide
  Target: AGXT; (+) strand; PAM type: NRG; PAM sequence: CGG
accagaccctggaaccaggc

SEQ ID NO: 12924 - DNA, 20 bp, Artificial Sequence
  Description of Artificial Sequence: Synthetic oligonucleotide
  Target: AGXT; (+) strand; PAM type: NRG; PAM sequence: AAG
agaccctggaaccaggccgg

SEQ ID NO: 12925 - DNA, 20 bp, Artificial Sequence
  Description of Artificial Sequence: Synthetic oligonucleotide
  Target: AGXT; (+) strand; PAM type: NRG; PAM sequence: TGG
caggccggaagccccacgcc

SEQ ID NO: 12926 - DNA, 20 bp, Artificial Sequence
  Description of Artificial Sequence: Synthetic oligonucleotide
  Target: AGXT; (+) strand; PAM type: NRG; PAM sequence: GGG
aggccggaagccccacgcct

SEQ ID NO: 12927 - DNA, 20 bp, Artificial Sequence
  Description of Artificial Sequence: Synthetic oligonucleotide
  Target: AGXT; (+) strand; PAM type: NRG; PAM sequence: TGG
ggaagccccacgcctgggcc

SEQ ID NO: 12928 - DNA, 20 bp, Artificial Sequence
  Description of Artificial Sequence: Synthetic oligonucleotide
  Target: AGXT; (+) strand; PAM type: NRG; PAM sequence: GAG
ctgggcctggctgtgtctct

SEQ ID NO: 12929 - DNA, 20 bp, Artificial Sequence
  Description of Artificial Sequence: Synthetic oligonucleotide
  Target: AGXT; (+) strand; PAM type: NRG; PAM sequence: TGG
ggcctggctgtgtctctgag

SEQ ID NO: 12930 - DNA, 20 bp, Artificial Sequence
  Description of Artificial Sequence: Synthetic oligonucleotide
  Target: AGXT; (+) strand; PAM type: NRG; PAM sequence: CAG
ctggctgtgtctctgagtgg

SEQ ID NO: 12931 - DNA, 20 bp, Artificial Sequence
  Description of Artificial Sequence: Synthetic oligonucleotide
  Target: AGXT; (+) strand; PAM type: NRG; PAM sequence: TGG
gctgtgtctctgagtggcag

SEQ ID NO: 12932 - DNA, 20 bp, Artificial Sequence
  Description of Artificial Sequence: Synthetic oligonucleotide
  Target: AGXT; (+) strand; PAM type: NRG; PAM sequence: GGG
ctgtgtctctgagtggcagt

SEQ ID NO: 12933 - DNA, 20 bp, Artificial Sequence
  Description of Artificial Sequence: Synthetic oligonucleotide
  Target: AGXT; (+) strand; PAM type: NRG; PAM sequence: GGG
tgtgtctctgagtggcagtg

SEQ ID NO: 12934 - DNA, 20 bp, Artificial Sequence
  Description of Artificial Sequence: Synthetic oligonucleotide
  Target: AGXT; (+) strand; PAM type: NRG; PAM sequence: GAG
tgtctctgagtggcagtggg

SEQ ID NO: 12935 - DNA, 20 bp, Artificial Sequence
  Description of Artificial Sequence: Synthetic oligonucleotide
  Target: AGXT; (+) strand; PAM type: NRG; PAM sequence: AGG
gtctctgagtggcagtgggg

SEQ ID NO: 12936 - DNA, 20 bp, Artificial Sequence
  Description of Artificial Sequence: Synthetic oligonucleotide
  Target: AGXT; (+) strand; PAM type: NRG; PAM sequence: GGG
tctctgagtggcagtgggga

SEQ ID NO: 12937 - DNA, 20 bp, Artificial Sequence
  Description of Artificial Sequence: Synthetic oligonucleotide
  Target: AGXT; (+) strand; PAM type: NRG; PAM sequence: TGG
caccaccctgtcctcccgtg

SEQ ID NO: 12938 - DNA, 20 bp, Artificial Sequence
  Description of Artificial Sequence: Synthetic oligonucleotide
  Target: AGXT; (+) strand; PAM type: NRG; PAM sequence: CGG
cctgtcctcccgtgtggctg

SEQ ID NO: 12939 - DNA, 20 bp, Artificial Sequence
  Description of Artificial Sequence: Synthetic oligonucleotide
  Target: AGXT; (+) strand; PAM type: NRG; PAM sequence: GGG
ctgtcctcccgtgtggctgc

SEQ ID NO: 12940 - DNA, 20 bp, Artificial Sequence
  Description of Artificial Sequence: Synthetic oligonucleotide
  Target: AGXT; (+) strand; PAM type: NRG; PAM sequence: CAG
ctcccgtgtggctgcgggtg

SEQ ID NO: 12941 - DNA, 20 bp, Artificial Sequence
  Description of Artificial Sequence: Synthetic oligonucleotide
  Target: AGXT; (+) strand; PAM type: NRG; PAM sequence: GAG
cccgtgtggctgcgggtgca

SEQ ID NO: 12942 - DNA, 20 bp, Artificial Sequence
  Description of Artificial Sequence: Synthetic oligonucleotide
  Target: AGXT; (+) strand; PAM type: NRG; PAM sequence: AGG
ccgtgtggctgcgggtgcag

SEQ ID NO: 12943 - DNA, 20 bp, Artificial Sequence
  Description of Artificial Sequence: Synthetic oligonucleotide
  Target: AGXT; (+) strand; PAM type: NRG; PAM sequence: GGG
cgtgtggctgcgggtgcaga

SEQ ID NO: 12944 - DNA, 20 bp, Artificial Sequence
  Description of Artificial Sequence: Synthetic oligonucleotide
  Target: AGXT; (+) strand; PAM type: NRG; PAM sequence: GAG
tgtggctgcgggtgcagagg

SEQ ID NO: 12945 - DNA, 20 bp, Artificial Sequence
  Description of Artificial Sequence: Synthetic oligonucleotide
  Target: AGXT; (+) strand; PAM type: NRG; PAM sequence: AGG
gtggctgcgggtgcagaggg

SEQ ID NO: 12946 - DNA, 20 bp, Artificial Sequence
  Description of Artificial Sequence: Synthetic oligonucleotide
  Target: AGXT; (+) strand; PAM type: NRG; PAM sequence: GAG
ggctgcgggtgcagagggag

SEQ ID NO: 12947 - DNA, 20 bp, Artificial Sequence
  Description of Artificial Sequence: Synthetic oligonucleotide
  Target: AGXT; (+) strand; PAM type: NRG; PAM sequence: GAG
ctgcgggtgcagagggagga

SEQ ID NO: 12948 - DNA, 20 bp, Artificial Sequence
  Description of Artificial Sequence: Synthetic oligonucleotide
  Target: AGXT; (+) strand; PAM type: NRG; PAM sequence: TGG
agagggaggagagcctgccc

SEQ ID NO: 12949 - DNA, 20 bp, Artificial Sequence
  Description of Artificial Sequence: Synthetic oligonucleotide
  Target: AGXT; (+) strand; PAM type: NRG; PAM sequence: TGG
gaggagagcctgccctggcc

SEQ ID NO: 12950 - DNA, 20 bp, Artificial Sequence
  Description of Artificial Sequence: Synthetic oligonucleotide
  Target: AGXT; (+) strand; PAM type: NRG; PAM sequence: GGG
aggagagcctgccctggcct

SEQ ID NO: 12951 - DNA, 20 bp, Artificial Sequence
  Description of Artificial Sequence: Synthetic oligonucleotide
  Target: AGXT; (+) strand; PAM type: NRG; PAM sequence: AAG
ctgccctggcctgggtgctc

SEQ ID NO: 12952 - DNA, 20 bp, Artificial Sequence
  Description of Artificial Sequence: Synthetic oligonucleotide
  Target: AGXT; (+) strand; PAM type: NRG; PAM sequence: AGG
tgccctggcctgggtgctca

SEQ ID NO: 12953 - DNA, 20 bp, Artificial Sequence
  Description of Artificial Sequence: Synthetic oligonucleotide
  Target: AGXT; (+) strand; PAM type: NRG; PAM sequence: GGG
gccctggcctgggtgctcaa

SEQ ID NO: 12954 - DNA, 20 bp, Artificial Sequence
  Description of Artificial Sequence: Synthetic oligonucleotide
  Target: AGXT; (+) strand; PAM type: NRG; PAM sequence: CAG
ggccccctctgtgacctgca

SEQ ID NO: 12955 - DNA, 20 bp, Artificial Sequence
  Description of Artificial Sequence: Synthetic oligonucleotide
  Target: AGXT; (+) strand; PAM type: NRG; PAM sequence: AGG
gccccctctgtgacctgcac

SEQ ID NO: 12956 - DNA, 20 bp, Artificial Sequence
  Description of Artificial Sequence: Synthetic oligonucleotide
  Target: AGXT; (+) strand; PAM type: NRG; PAM sequence: GGG
ccccctctgtgacctgcaca

SEQ ID NO: 12957 - DNA, 20 bp, Artificial Sequence
  Description of Artificial Sequence: Synthetic oligonucleotide
  Target: AGXT; (+) strand; PAM type: NRG; PAM sequence: TGG
agggctgtcaactcccctca

SEQ ID NO: 12958 - DNA, 20 bp, Artificial Sequence
  Description of Artificial Sequence: Synthetic oligonucleotide
  Target: AGXT; (+) strand; PAM type: NRG; PAM sequence: TGG
tcaactcccctcatggacgc

SEQ ID NO: 12959 - DNA, 20 bp, Artificial Sequence
  Description of Artificial Sequence: Synthetic oligonucleotide
  Target: AGXT; (+) strand; PAM type: NRG; PAM sequence: GGG
caactcccctcatggacgct

SEQ ID NO: 12960 - DNA, 20 bp, Artificial Sequence
  Description of Artificial Sequence: Synthetic oligonucleotide
  Target: AGXT; (+) strand; PAM type: NRG; PAM sequence: TGG
ctcccctcatggacgctggg

SEQ ID NO: 12961 - DNA, 20 bp, Artificial Sequence
  Description of Artificial Sequence: Synthetic oligonucleotide
  Target: AGXT; (+) strand; PAM type: NRG; PAM sequence: GGG
tcccctcatggacgctgggt

SEQ ID NO: 12962 - DNA, 20 bp, Artificial Sequence
  Description of Artificial Sequence: Synthetic oligonucleotide
  Target: AGXT; (+) strand; PAM type: NRG; PAM sequence: TGG
cctcatggacgctgggtggg

SEQ ID NO: 12963 - DNA, 20 bp, Artificial Sequence
  Description of Artificial Sequence: Synthetic oligonucleotide
  Target: AGXT; (+) strand; PAM type: NRG; PAM sequence: CAG
ctgggtgggtggtcctcact

SEQ ID NO: 12964 - DNA, 20 bp, Artificial Sequence
  Description of Artificial Sequence: Synthetic oligonucleotide
  Target: AGXT; (+) strand; PAM type: NRG; PAM sequence: AGG
tgggtgggtggtcctcactc

SEQ ID NO: 12965 - DNA, 20 bp, Artificial Sequence
  Description of Artificial Sequence: Synthetic oligonucleotide
  Target: AGXT; (+) strand; PAM type: NRG; PAM sequence: GAG
tgggtggtcctcactcaggt

SEQ ID NO: 12966 - DNA, 20 bp, Artificial Sequence
  Description of Artificial Sequence: Synthetic oligonucleotide
  Target: AGXT; (+) strand; PAM type: NRG; PAM sequence: TGG
tcactcaggtgagcccatcc

SEQ ID NO: 12967 - DNA, 20 bp, Artificial Sequence
  Description of Artificial Sequence: Synthetic oligonucleotide
  Target: AGXT; (+) strand; PAM type: NRG; PAM sequence: TGG
aggtgagcccatcctggctc

SEQ ID NO: 12968 - DNA, 20 bp, Artificial Sequence
  Description of Artificial Sequence: Synthetic oligonucleotide
  Target: AGXT; (+) strand; PAM type: NRG; PAM sequence: CAG
gagcccatcctggctctggc

SEQ ID NO: 12969 - DNA, 20 bp, Artificial Sequence
  Description of Artificial Sequence: Synthetic oligonucleotide
  Target: AGXT; (+) strand; PAM type: NRG; PAM sequence: CGG
tcctggctctggccagctgt

SEQ ID NO: 12970 - DNA, 20 bp, Artificial Sequence
  Description of Artificial Sequence: Synthetic oligonucleotide
  Target: AGXT; (+) strand; PAM type: NRG; PAM sequence: CAG
ggctctggccagctgtcggt

SEQ ID NO: 12971 - DNA, 20 bp, Artificial Sequence
  Description of Artificial Sequence: Synthetic oligonucleotide
  Target: AGXT; (+) strand; PAM type: NRG; PAM sequence: AGG
gctctggccagctgtcggtc

SEQ ID NO: 12972 - DNA, 20 bp, Artificial Sequence
  Description of Artificial Sequence: Synthetic oligonucleotide
  Target: AGXT; (+) strand; PAM type: NRG; PAM sequence: GGG
ctctggccagctgtcggtca

SEQ ID NO: 12973 - DNA, 20 bp, Artificial Sequence
  Description of Artificial Sequence: Synthetic oligonucleotide
  Target: AGXT; (+) strand; PAM type: NRG; PAM sequence: CAG
ggccagctgtcggtcagggt

SEQ ID NO: 12974 - DNA, 20 bp, Artificial Sequence
  Description of Artificial Sequence: Synthetic oligonucleotide
  Target: AGXT; (+) strand; PAM type: NRG; PAM sequence: AGG
gccagctgtcggtcagggtc

SEQ ID NO: 12975 - DNA, 20 bp, Artificial Sequence
  Description of Artificial Sequence: Synthetic oligonucleotide
  Target: AGXT; (+) strand; PAM type: NRG; PAM sequence: CAG
agctgtcggtcagggtcagg

SEQ ID NO: 12976 - DNA, 20 bp, Artificial Sequence
  Description of Artificial Sequence: Synthetic oligonucleotide
  Target: AGXT; (+) strand; PAM type: NRG; PAM sequence: AGG
gctgtcggtcagggtcaggc

SEQ ID NO: 12977 - DNA, 20 bp, Artificial Sequence
  Description of Artificial Sequence: Synthetic oligonucleotide
  Target: AGXT; (+) strand; PAM type: NRG; PAM sequence: CAG
ggtcagggtcaggcaggtcc

SEQ ID NO: 12978 - DNA, 20 bp, Artificial Sequence
  Description of Artificial Sequence: Synthetic oligonucleotide
  Target: AGXT; (+) strand; PAM type: NRG; PAM sequence: AGG
gtcagggtcaggcaggtccc

SEQ ID NO: 12979 - DNA, 20 bp, Artificial Sequence
  Description of Artificial Sequence: Synthetic oligonucleotide
  Target: AGXT; (+) strand; PAM type: NRG; PAM sequence: CGG
agggtcaggcaggtcccagg

SEQ ID NO: 12980 - DNA, 20 bp, Artificial Sequence
  Description of Artificial Sequence: Synthetic oligonucleotide
  Target: AGXT; (+) strand; PAM type: NRG; PAM sequence: GGG
gggtcaggcaggtcccaggc

SEQ ID NO: 12981 - DNA, 20 bp, Artificial Sequence
  Description of Artificial Sequence: Synthetic oligonucleotide
  Target: AGXT; (+) strand; PAM type: NRG; PAM sequence: GAG
gtcaggcaggtcccaggcgg

SEQ ID NO: 12982 - DNA, 20 bp, Artificial Sequence
  Description of Artificial Sequence: Synthetic oligonucleotide
  Target: AGXT; (+) strand; PAM type: NRG; PAM sequence: AGG
tcaggcaggtcccaggcggg

SEQ ID NO: 12983 - DNA, 20 bp, Artificial Sequence
  Description of Artificial Sequence: Synthetic oligonucleotide
  Target: AGXT; (+) strand; PAM type: NRG; PAM sequence: CAG
cccaggcgggaggctgacgt

SEQ ID NO: 12984 - DNA, 20 bp, Artificial Sequence
  Description of Artificial Sequence: Synthetic oligonucleotide
  Target: AGXT; (+) strand; PAM type: NRG; PAM sequence: CAG
tcagcccgccctgtgccccc

SEQ ID NO: 12985 - DNA, 20 bp, Artificial Sequence
  Description of Artificial Sequence: Synthetic oligonucleotide
  Target: AGXT; (+) strand; PAM type: NRG; PAM sequence: AGG
cagcccgccctgtgcccccc

SEQ ID NO: 12986 - DNA, 20 bp, Artificial Sequence
  Description of Artificial Sequence: Synthetic oligonucleotide
  Target: AGXT; (+) strand; PAM type: NRG; PAM sequence: CGG
cctgtgccccccaggtgctg

SEQ ID NO: 12987 - DNA, 20 bp, Artificial Sequence
  Description of Artificial Sequence: Synthetic oligonucleotide
  Target: AGXT; (+) strand; PAM type: NRG; PAM sequence: CGG
gccccccaggtgctgcggat

SEQ ID NO: 12988 - DNA, 20 bp, Artificial Sequence
  Description of Artificial Sequence: Synthetic oligonucleotide
  Target: AGXT; (+) strand; PAM type: NRG; PAM sequence: TGG
ggtgctgcggatcggcctgc

SEQ ID NO: 12989 - DNA, 20 bp, Artificial Sequence
  Description of Artificial Sequence: Synthetic oligonucleotide
  Target: AGXT; (+) strand; PAM type: NRG; PAM sequence: GGG
gtgctgcggatcggcctgct

SEQ ID NO: 12990 - DNA, 20 bp, Artificial Sequence
  Description of Artificial Sequence: Synthetic oligonucleotide
  Target: AGXT; (+) strand; PAM type: NRG; PAM sequence: GAG
tgggctgcaatgccacccgc

SEQ ID NO: 12991 - DNA, 20 bp, Artificial Sequence
  Description of Artificial Sequence: Synthetic oligonucleotide
  Target: AGXT; (+) strand; PAM type: NRG; PAM sequence: TGG
caatgccacccgcgagaatg

SEQ ID NO: 12992 - DNA, 20 bp, Artificial Sequence
  Description of Artificial Sequence: Synthetic oligonucleotide
  Target: AGXT; (+) strand; PAM type: NRG; PAM sequence: CGG
cgagaatgtggaccgcgtga

SEQ ID NO: 12993 - DNA, 20 bp, Artificial Sequence
  Description of Artificial Sequence: Synthetic oligonucleotide
  Target: AGXT; (+) strand; PAM type: NRG; PAM sequence: GAG
agaatgtggaccgcgtgacg

SEQ ID NO: 12994 - DNA, 20 bp, Artificial Sequence
  Description of Artificial Sequence: Synthetic oligonucleotide
  Target: AGXT; (+) strand; PAM type: NRG; PAM sequence: AGG
gaatgtggaccgcgtgacgg

SEQ ID NO: 12995 - DNA, 20 bp, Artificial Sequence
  Description of Artificial Sequence: Synthetic oligonucleotide
  Target: AGXT; (+) strand; PAM type: NRG; PAM sequence: GAG
gaccgcgtgacggaggccct

SEQ ID NO: 12996 - DNA, 20 bp, Artificial Sequence
  Description of Artificial Sequence: Synthetic oligonucleotide
  Target: AGXT; (+) strand; PAM type: NRG; PAM sequence: AGG
accgcgtgacggaggccctg

SEQ ID NO: 12997 - DNA, 20 bp, Artificial Sequence
  Description of Artificial Sequence: Synthetic oligonucleotide
  Target: AGXT; (+) strand; PAM type: NRG; PAM sequence: GGG
ccgcgtgacggaggccctga

SEQ ID NO: 12998 - DNA, 20 bp, Artificial Sequence
  Description of Artificial Sequence: Synthetic oligonucleotide
  Target: AGXT; (+) strand; PAM type: NRG; PAM sequence: CGG
cgtgacggaggccctgaggg

SEQ ID NO: 12999 - DNA, 20 bp, Artificial Sequence
  Description of Artificial Sequence: Synthetic oligonucleotide
  Target: AGXT; (+) strand; PAM type: NRG; PAM sequence: CAG
aggccctgagggcggccctg

SEQ ID NO: 13000 - DNA, 20 bp, Artificial Sequence
  Description of Artificial Sequence: Synthetic oligonucleotide
  Target: AGXT; (+) strand; PAM type: NRG; PAM sequence: AAG
cggccctgcagcactgcccc

SEQ ID NO: 13001 - DNA, 20 bp, Artificial Sequence
  Description of Artificial Sequence: Synthetic oligonucleotide
  Target: AGXT; (+) strand; PAM type: NRG; PAM sequence: AAG
ccctgcagcactgccccaag

SEQ ID NO: 13002 - DNA, 20 bp, Artificial Sequence
  Description of Artificial Sequence: Synthetic oligonucleotide
  Target: AGXT; (+) strand; PAM type: NRG; PAM sequence: AAG
tgcagcactgccccaagaag

SEQ ID NO: 13003 - DNA, 20 bp, Artificial Sequence
  Description of Artificial Sequence: Synthetic oligonucleotide
  Target: AGXT; (+) strand; PAM type: NRG; PAM sequence: TGG
agaagctgtgacctgcccac

SEQ ID NO: 13004 - DNA, 20 bp, Artificial Sequence
  Description of Artificial Sequence: Synthetic oligonucleotide
  Target: AGXT; (+) strand; PAM type: NRG; PAM sequence: CAG
gtgacctgcccactggcaca

SEQ ID NO: 13005 - DNA, 20 bp, Artificial Sequence
  Description of Artificial Sequence: Synthetic oligonucleotide
  Target: AGXT; (+) strand; PAM type: NRG; PAM sequence: TGG
cctgcccactggcacacagc

SEQ ID NO: 13006 - DNA, 20 bp, Artificial Sequence
  Description of Artificial Sequence: Synthetic oligonucleotide
  Target: AGXT; (+) strand; PAM type: NRG; PAM sequence: TGG
cactggcacacagctggcac

SEQ ID NO: 13007 - DNA, 20 bp, Artificial Sequence
  Description of Artificial Sequence: Synthetic oligonucleotide
  Target: AGXT; (+) strand; PAM type: NRG; PAM sequence: GAG
acctgtcccatgcccaccct

SEQ ID NO: 13008 - DNA, 20 bp, Artificial Sequence
  Description of Artificial Sequence: Synthetic oligonucleotide
  Target: AGXT; (+) strand; PAM type: NRG; PAM sequence: AGG
cctgtcccatgcccaccctg

SEQ ID NO: 13009 - DNA, 20 bp, Artificial Sequence
  Description of Artificial Sequence: Synthetic oligonucleotide
  Target: AGXT; (+) strand; PAM type: NRG; PAM sequence: GGG
ctgtcccatgcccaccctga

SEQ ID NO: 13010 - DNA, 20 bp, Artificial Sequence
  Description of Artificial Sequence: Synthetic oligonucleotide
  Target: AGXT; (+) strand; PAM type: NRG; PAM sequence: CAG
ccatgcccaccctgagggat

SEQ ID NO: 13011 - DNA, 20 bp, Artificial Sequence
  Description of Artificial Sequence: Synthetic oligonucleotide
  Target: AGXT; (+) strand; PAM type: NRG; PAM sequence: AGG
catgcccaccctgagggatc

SEQ ID NO: 13012 - DNA, 20 bp, Artificial Sequence
  Description of Artificial Sequence: Synthetic oligonucleotide
  Target: AGXT; (+) strand; PAM type: NRG; PAM sequence: GAG
tgcccaccctgagggatcag

SEQ ID NO: 13013 - DNA, 20 bp, Artificial Sequence
  Description of Artificial Sequence: Synthetic oligonucleotide
  Target: AGXT; (+) strand; PAM type: NRG; PAM sequence: CAG
cctgagggatcaggagcaaa

SEQ ID NO: 13014 - DNA, 20 bp, Artificial Sequence
  Description of Artificial Sequence: Synthetic oligonucleotide
  Target: AGXT; (+) strand; PAM type: NRG; PAM sequence: AAG
caggagcaaacagaccctgc

SEQ ID NO: 13015 - DNA, 20 bp, Artificial Sequence
  Description of Artificial Sequence: Synthetic oligonucleotide
  Target: AGXT; (+) strand; PAM type: NRG; PAM sequence: AGG
aggagcaaacagaccctgca

SEQ ID NO: 13016 - DNA, 20 bp, Artificial Sequence
  Description of Artificial Sequence: Synthetic oligonucleotide
  Target: AGXT; (+) strand; PAM type: NRG; PAM sequence: CAG
acagaccctgcaaggtcctc

SEQ ID NO: 13017 - DNA, 20 bp, Artificial Sequence
  Description of Artificial Sequence: Synthetic oligonucleotide
  Target: AGXT; (+) strand; PAM type: NRG; PAM sequence: AGG
cagaccctgcaaggtcctcc

SEQ ID NO: 13018 - DNA, 20 bp, Artificial Sequence
  Description of Artificial Sequence: Synthetic oligonucleotide
  Target: AGXT; (+) strand; PAM type: NRG; PAM sequence: TGG
cctgcaaggtcctccaggcc

SEQ ID NO: 13019 - DNA, 20 bp, Artificial Sequence
  Description of Artificial Sequence: Synthetic oligonucleotide
  Target: AGXT; (+) strand; PAM type: NRG; PAM sequence: GGG
ctgcaaggtcctccaggcct

SEQ ID NO: 13020 - DNA, 20 bp, Artificial Sequence
  Description of Artificial Sequence: Synthetic oligonucleotide
  Target: AGXT; (+) strand; PAM type: NRG; PAM sequence: GGG
tgcaaggtcctccaggcctg

SEQ ID NO: 13021 - DNA, 20 bp, Artificial Sequence
  Description of Artificial Sequence: Synthetic oligonucleotide
  Target: AGXT; (+) strand; PAM type: NRG; PAM sequence: CAG
aggtcctccaggcctgggga

SEQ ID NO: 13022 - DNA, 20 bp, Artificial Sequence
  Description of Artificial Sequence: Synthetic oligonucleotide
  Target: AGXT; (+) strand; PAM type: NRG; PAM sequence: AGG
ggtcctccaggcctggggac

SEQ ID NO: 13023 - DNA, 20 bp, Artificial Sequence
  Description of Artificial Sequence: Synthetic oligonucleotide
  Target: AGXT; (+) strand; PAM type: NRG; PAM sequence: AAG
ctccaggcctggggacagga

SEQ ID NO: 13024 - DNA, 20 bp, Artificial Sequence
  Description of Artificial Sequence: Synthetic oligonucleotide
  Target: AGXT; (+) strand; PAM type: NRG; PAM sequence: CAG
ggacaggaaagccactgacc

SEQ ID NO: 13025 - DNA, 20 bp, Artificial Sequence
  Description of Artificial Sequence: Synthetic oligonucleotide
  Target: AGXT; (+) strand; PAM type: NRG; PAM sequence: CGG
ggaaagccactgacccagcc

SEQ ID NO: 13026 - DNA, 20 bp, Artificial Sequence
  Description of Artificial Sequence: Synthetic oligonucleotide
  Target: AGXT; (+) strand; PAM type: NRG; PAM sequence: GGG
gaaagccactgacccagccc

SEQ ID NO: 13027 - DNA, 20 bp, Artificial Sequence
  Description of Artificial Sequence: Synthetic oligonucleotide
  Target: AGXT; (+) strand; PAM type: NRG; PAM sequence: GAG
aagccactgacccagcccgg

SEQ ID NO: 13028 - DNA, 20 bp, Artificial Sequence
  Description of Artificial Sequence: Synthetic oligonucleotide
  Target: AGXT; (+) strand; PAM type: NRG; PAM sequence: AGG
agccactgacccagcccggg

SEQ ID NO: 13029 - DNA, 20 bp, Artificial Sequence
  Description of Artificial Sequence: Synthetic oligonucleotide
  Target: AGXT; (+) strand; PAM type: NRG; PAM sequence: CAG
cactgacccagcccgggagg

SEQ ID NO: 13030 - DNA, 20 bp, Artificial Sequence
  Description of Artificial Sequence: Synthetic oligonucleotide
  Target: AGXT; (+) strand; PAM type: NRG; PAM sequence: CAG
cccagcccgggaggcagaac

SEQ ID NO: 13031 - DNA, 20 bp, Artificial Sequence
  Description of Artificial Sequence: Synthetic oligonucleotide
  Target: AGXT; (+) strand; PAM type: NRG; PAM sequence: AGG
ccagcccgggaggcagaacc

SEQ ID NO: 13032 - DNA, 20 bp, Artificial Sequence
  Description of Artificial Sequence: Synthetic oligonucleotide
  Target: AGXT; (+) strand; PAM type: NRG; PAM sequence: CAG
gcccgggaggcagaaccagg

SEQ ID NO: 13033 - DNA, 20 bp, Artificial Sequence
  Description of Artificial Sequence: Synthetic oligonucleotide
  Target: AGXT; (+) strand; PAM type: NRG; PAM sequence: TGG
gcagaaccaggcagcctccc

SEQ ID NO: 13034 - DNA, 20 bp, Artificial Sequence
  Description of Artificial Sequence: Synthetic oligonucleotide
  Target: AGXT; (+) strand; PAM type: NRG; PAM sequence: CAG
ccaggcagcctccctggccc

SEQ ID NO: 13035 - DNA, 20 bp, Artificial Sequence
  Description of Artificial Sequence: Synthetic oligonucleotide
  Target: AGXT; (+) strand; PAM type: NRG; PAM sequence: AGG
caggcagcctccctggcccc

SEQ ID NO: 13036 - DNA, 20 bp, Artificial Sequence
  Description of Artificial Sequence: Synthetic oligonucleotide
  Target: AGXT; (+) strand; PAM type: NRG; PAM sequence: CAG
gcagcctccctggccccagg

SEQ ID NO: 13037 - DNA, 20 bp, Artificial Sequence
  Description of Artificial Sequence: Synthetic oligonucleotide
  Target: AGXT; (+) strand; PAM type: NRG; PAM sequence: CAG
ccaggcagcccttttccctc

SEQ ID NO: 13038 - DNA, 20 bp, Artificial Sequence
  Description of Artificial Sequence: Synthetic oligonucleotide
  Target: AGXT; (+) strand; PAM type: NRG; PAM sequence: TGG
ggcagcccttttccctccag

SEQ ID NO: 13039 - DNA, 20 bp, Artificial Sequence
  Description of Artificial Sequence: Synthetic oligonucleotide
  Target: AGXT; (+) strand; PAM type: NRG; PAM sequence: TGG
ttccctccagtggcacctcc

SEQ ID NO: 13040 - DNA, 20 bp, Artificial Sequence
  Description of Artificial Sequence: Synthetic oligonucleotide
  Target: AGXT; (+) strand; PAM type: NRG; PAM sequence: CAG
ccagtggcacctcctggaaa

SEQ ID NO: 13041 - DNA, 20 bp, Artificial Sequence
  Description of Artificial Sequence: Synthetic oligonucleotide
  Target: AGXT; (+) strand; PAM type: NRG; PAM sequence: TGG
cctcctggaaacagtccact

SEQ ID NO: 13042 - DNA, 20 bp, Artificial Sequence
  Description of Artificial Sequence: Synthetic oligonucleotide
  Target: AGXT; (+) strand; PAM type: NRG; PAM sequence: GGG
ctcctggaaacagtccactt

SEQ ID NO: 13043 - DNA, 20 bp, Artificial Sequence
  Description of Artificial Sequence: Synthetic oligonucleotide
  Target: AGXT; (+) strand; PAM type: NRG; PAM sequence: CAG
gtccacttgggcgcaaaacc

SEQ ID NO: 13044 - DNA, 20 bp, Artificial Sequence
  Description of Artificial Sequence: Synthetic oligonucleotide
  Target: AGXT; (+) strand; PAM type: NRG; PAM sequence: GAG
aaacccagtgccttccaaat

SEQ ID NO: 13045 - DNA, 20 bp, Artificial Sequence
  Description of Artificial Sequence: Synthetic oligonucleotide
  Target: AGXT; (+) strand; PAM type: NRG; PAM sequence: CAG
agtgccttccaaatgagctg

SEQ ID NO: 13046 - DNA, 20 bp, Artificial Sequence
  Description of Artificial Sequence: Synthetic oligonucleotide
  Target: AGXT; (+) strand; PAM type: NRG; PAM sequence: CAG
tccaaatgagctgcagtccc

SEQ ID NO: 13047 - DNA, 20 bp, Artificial Sequence
  Description of Artificial Sequence: Synthetic oligonucleotide
  Target: AGXT; (+) strand; PAM type: NRG; PAM sequence: AGG
ccaaatgagctgcagtcccc

SEQ ID NO: 13048 - DNA, 20 bp, Artificial Sequence
  Description of Artificial Sequence: Synthetic oligonucleotide
  Target: AGXT; (+) strand; PAM type: NRG; PAM sequence: GAG
agctgcagtccccaggccat

SEQ ID NO: 13049 - DNA, 20 bp, Artificial Sequence
  Description of Artificial Sequence: Synthetic oligonucleotide
  Target: AGXT; (+) strand; PAM type: NRG; PAM sequence: CGG
tccccaggccatgagcctcc

SEQ ID NO: 13050 - DNA, 20 bp, Artificial Sequence
  Description of Artificial Sequence: Synthetic oligonucleotide
  Target: AGXT; (+) strand; PAM type: NRG; PAM sequence: GGG
ccccaggccatgagcctccc

SEQ ID NO: 13051 - DNA, 20 bp, Artificial Sequence
  Description of Artificial Sequence: Synthetic oligonucleotide
  Target: AGXT; (+) strand; PAM type: NRG; PAM sequence: AAG
cctcccgggaatgtttaata

SEQ ID NO: 13052 - DNA, 20 bp, Artificial Sequence
  Description of Artificial Sequence: Synthetic oligonucleotide
  Target: AGXT; (+) strand; PAM type: NRG; PAM sequence: AGG
ctcccgggaatgtttaataa

SEQ ID NO: 13053 - DNA, 20 bp, Artificial Sequence
  Description of Artificial Sequence: Synthetic oligonucleotide
  Target: AGXT; (+) strand; PAM type: NRG; PAM sequence: GGG
tcccgggaatgtttaataaa

SEQ ID NO: 13054 - DNA, 20 bp, Artificial Sequence
  Description of Artificial Sequence: Synthetic oligonucleotide
  Target: AGXT; (+) strand; PAM type: NRG; PAM sequence: TGG
ggaatgtttaataaagggcc

SEQ ID NO: 13055 - DNA, 20 bp, Artificial Sequence
  Description of Artificial Sequence: Synthetic oligonucleotide
  Target: AGXT; (+) strand; PAM type: NRG; PAM sequence: TGG
ggccaactctcctcactgtg

SEQ ID NO: 13056 - DNA, 20 bp, Artificial Sequence
  Description of Artificial Sequence: Synthetic oligonucleotide
  Target: AGXT; (+) strand; PAM type: NRG; PAM sequence: GGG
gccaactctcctcactgtgt

SEQ ID NO: 13057 - DNA, 20 bp, Artificial Sequence
  Description of Artificial Sequence: Synthetic oligonucleotide
  Target: AGXT; (+) strand; PAM type: NRG; PAM sequence: GGG
ccaactctcctcactgtgtg

SEQ ID NO: 13058 - DNA, 20 bp, Artificial Sequence
  Description of Artificial Sequence: Synthetic oligonucleotide
  Target: AGXT; (+) strand; PAM type: NRG; PAM sequence: TGG
actctcctcactgtgtgggg

SEQ ID NO: 13059 - DNA, 20 bp, Artificial Sequence
  Description of Artificial Sequence: Synthetic oligonucleotide
  Target: AGXT; (+) strand; PAM type: NRG; PAM sequence: AAG
ctgtgtggggtggtctgtga

SEQ ID NO: 13060 - DNA, 20 bp, Artificial Sequence
  Description of Artificial Sequence: Synthetic oligonucleotide
  Target: AGXT; (+) strand; PAM type: NRG; PAM sequence: GAG
gtgtggggtggtctgtgaaa

SEQ ID NO: 13061 - DNA, 20 bp, Artificial Sequence
  Description of Artificial Sequence: Synthetic oligonucleotide
  Target: AGXT; (+) strand; PAM type: NRG; PAM sequence: GAG
ggggtggtctgtgaaagagt

SEQ ID NO: 13062 - DNA, 20 bp, Artificial Sequence
  Description of Artificial Sequence: Synthetic oligonucleotide
  Target: AGXT; (+) strand; PAM type: NRG; PAM sequence: GAG
ggtggtctgtgaaagagtga

SEQ ID NO: 13063 - DNA, 20 bp, Artificial Sequence
  Description of Artificial Sequence: Synthetic oligonucleotide
  Target: AGXT; (+) strand; PAM type: NRG; PAM sequence: AGG
gtggtctgtgaaagagtgag

SEQ ID NO: 13064 - DNA, 20 bp, Artificial Sequence
  Description of Artificial Sequence: Synthetic oligonucleotide
  Target: AGXT; (+) strand; PAM type: NRG; PAM sequence: GAG
ggtctgtgaaagagtgagag

SEQ ID NO: 13065 - DNA, 20 bp, Artificial Sequence
  Description of Artificial Sequence: Synthetic oligonucleotide
  Target: AGXT; (+) strand; PAM type: NRG; PAM sequence: GAG
tctgtgaaagagtgagagga

SEQ ID NO: 13066 - DNA, 20 bp, Artificial Sequence
  Description of Artificial Sequence: Synthetic oligonucleotide
  Target: AGXT; (+) strand; PAM type: NRG; PAM sequence: GAG
ggagagcatctctgctccct

SEQ ID NO: 13067 - DNA, 20 bp, Artificial Sequence
  Description of Artificial Sequence: Synthetic oligonucleotide
  Target: AGXT; (+) strand; PAM type: NRG; PAM sequence: TGG
ctccctgagctgcctgattg

SEQ ID NO: 13068 - DNA, 20 bp, Artificial Sequence
  Description of Artificial Sequence: Synthetic oligonucleotide
  Target: AGXT; (+) strand; PAM type: NRG; PAM sequence: TAG
agctgcctgattgtggactt

SEQ ID NO: 13069 - DNA, 20 bp, Artificial Sequence
  Description of Artificial Sequence: Synthetic oligonucleotide
  Target: AGXT; (+) strand; PAM type: NRG; PAM sequence: AGG
gctgcctgattgtggacttt

SEQ ID NO: 13070 - DNA, 20 bp, Artificial Sequence
  Description of Artificial Sequence: Synthetic oligonucleotide
  Target: AGXT; (+) strand; PAM type: NRG; PAM sequence: GGG
ctgcctgattgtggacttta

SEQ ID NO: 13071 - DNA, 20 bp, Artificial Sequence
  Description of Artificial Sequence: Synthetic oligonucleotide
  Target: AGXT; (+) strand; PAM type: NRG; PAM sequence: GGG
tgcctgattgtggactttag

SEQ ID NO: 13072 - DNA, 20 bp, Artificial Sequence
  Description of Artificial Sequence: Synthetic oligonucleotide
  Target: AGXT; (+) strand; PAM type: NRG; PAM sequence: GGG
gcctgattgtggactttagg

SEQ ID NO: 13073 - DNA, 20 bp, Artificial Sequence
  Description of Artificial Sequence: Synthetic oligonucleotide
  Target: AGXT; (+) strand; PAM type: NRG; PAM sequence: TGG
tagggggacactcctcatcc

SEQ ID NO: 13074 - DNA, 20 bp, Artificial Sequence
  Description of Artificial Sequence: Synthetic oligonucleotide
  Target: AGXT; (+) strand; PAM type: NRG; PAM sequence: GAG
gggggacactcctcatcctg

SEQ ID NO: 13075 - DNA, 20 bp, Artificial Sequence
  Description of Artificial Sequence: Synthetic oligonucleotide
  Target: AGXT; (+) strand; PAM type: NRG; PAM sequence: CAG
actcctcatcctggagccca

SEQ ID NO: 13076 - DNA, 20 bp, Artificial Sequence
  Description of Artificial Sequence: Synthetic oligonucleotide
  Target: AGXT; (+) strand; PAM type: NRG; PAM sequence: AGG
ctcctcatcctggagcccac

SEQ ID NO: 13077 - DNA, 20 bp, Artificial Sequence
  Description of Artificial Sequence: Synthetic oligonucleotide
  Target: AGXT; (+) strand; PAM type: NRG; PAM sequence: GGG
tcctcatcctggagcccaca

SEQ ID NO: 13078 - DNA, 20 bp, Artificial Sequence
  Description of Artificial Sequence: Synthetic oligonucleotide
  Target: AGXT; (+) strand; PAM type: NRG; PAM sequence: TAG
tcatcctggagcccacaggg

SEQ ID NO: 13079 - DNA, 20 bp, Artificial Sequence
  Description of Artificial Sequence: Synthetic oligonucleotide
  Target: AGXT; (+) strand; PAM type: NRG; PAM sequence: TGG
ccacagggtagatcctcccc

SEQ ID NO: 13080 - DNA, 20 bp, Artificial Sequence
  Description of Artificial Sequence: Synthetic oligonucleotide
  Target: AGXT; (+) strand; PAM type: NRG; PAM sequence: GAG
acagggtagatcctcccctg

SEQ ID NO: 13081 - DNA, 20 bp, Artificial Sequence
  Description of Artificial Sequence: Synthetic oligonucleotide
  Target: AGXT; (+) strand; PAM type: NRG; PAM sequence: AGG
cagggtagatcctcccctgg

SEQ ID NO: 13082 - DNA, 20 bp, Artificial Sequence
  Description of Artificial Sequence: Synthetic oligonucleotide
  Target: AGXT; (+) strand; PAM type: NRG; PAM sequence: GAG
gggtagatcctcccctggag

SEQ ID NO: 13083 - DNA, 20 bp, Artificial Sequence
  Description of Artificial Sequence: Synthetic oligonucleotide
  Target: AGXT; (+) strand; PAM type: NRG; PAM sequence: AGG
ggtagatcctcccctggagg

SEQ ID NO: 13084 - DNA, 20 bp, Artificial Sequence
  Description of Artificial Sequence: Synthetic oligonucleotide
  Target: AGXT; (+) strand; PAM type: NRG; PAM sequence: TAG
gaggtgctgtcaccacactc

SEQ ID NO: 13085 - DNA, 20 bp, Artificial Sequence
  Description of Artificial Sequence: Synthetic oligonucleotide
  Target: AGXT; (+) strand; PAM type: NRG; PAM sequence: CAG
ctgtcaccacactctagccc

SEQ ID NO: 13086 - DNA, 20 bp, Artificial Sequence
  Description of Artificial Sequence: Synthetic oligonucleotide
  Target: AGXT; (+) strand; PAM type: NRG; PAM sequence: CAG
acgtcctcacgcaccacatc

SEQ ID NO: 13087 - DNA, 20 bp, Artificial Sequence
  Description of Artificial Sequence: Synthetic oligonucleotide
  Target: AGXT; (+) strand; PAM type: NRG; PAM sequence: AGG
cgtcctcacgcaccacatcc

SEQ ID NO: 13088 - DNA, 20 bp, Artificial Sequence
  Description of Artificial Sequence: Synthetic oligonucleotide
  Target: AGXT; (+) strand; PAM type: NRG; PAM sequence: CGG
cacatccaggtgaacccaca

SEQ ID NO: 13089 - DNA, 20 bp, Artificial Sequence
  Description of Artificial Sequence: Synthetic oligonucleotide
  Target: AGXT; (+) strand; PAM type: NRG; PAM sequence: CAG
aggtgaacccacacggcgca

SEQ ID NO: 13090 - DNA, 20 bp, Artificial Sequence
  Description of Artificial Sequence: Synthetic oligonucleotide
  Target: AGXT; (+) strand; PAM type: NRG; PAM sequence: AGG
ggtgaacccacacggcgcac

SEQ ID NO: 13091 - DNA, 20 bp, Artificial Sequence
  Description of Artificial Sequence: Synthetic oligonucleotide
  Target: AGXT; (+) strand; PAM type: NRG; PAM sequence: GGG
gtgaacccacacggcgcaca

SEQ ID NO: 13092 - DNA, 20 bp, Artificial Sequence
  Description of Artificial Sequence: Synthetic oligonucleotide
  Target: AGXT; (+) strand; PAM type: NRG; PAM sequence: TGG
acccacacggcgcacagggc

SEQ ID NO: 13093 - DNA, 20 bp, Artificial Sequence
  Description of Artificial Sequence: Synthetic oligonucleotide
  Target: AGXT; (+) strand; PAM type: NRG; PAM sequence: TGG
acacggcgcacagggctggt

SEQ ID NO: 13094 - DNA, 20 bp, Artificial Sequence
  Description of Artificial Sequence: Synthetic oligonucleotide
  Target: AGXT; (+) strand; PAM type: NRG; PAM sequence: GAG
acggcgcacagggctggttg

SEQ ID NO: 13095 - DNA, 20 bp, Artificial Sequence
  Description of Artificial Sequence: Synthetic oligonucleotide
  Target: AGXT; (+) strand; PAM type: NRG; PAM sequence: TGG
ctggttggagacccctgtca

SEQ ID NO: 13096 - DNA, 20 bp, Artificial Sequence
  Description of Artificial Sequence: Synthetic oligonucleotide
  Target: AGXT; (+) strand; PAM type: NRG; PAM sequence: AAG
tggagacccctgtcatggac

SEQ ID NO: 13097 - DNA, 20 bp, Artificial Sequence
  Description of Artificial Sequence: Synthetic oligonucleotide
  Target: AGXT; (+) strand; PAM type: NRG; PAM sequence: AGG
ggagacccctgtcatggaca

SEQ ID NO: 13098 - DNA, 20 bp, Artificial Sequence
  Description of Artificial Sequence: Synthetic oligonucleotide
  Target: AGXT; (+) strand; PAM type: NRG; PAM sequence: GGG
gagacccctgtcatggacaa

SEQ ID NO: 13099 - DNA, 20 bp, Artificial Sequence
  Description of Artificial Sequence: Synthetic oligonucleotide
  Target: AGXT; (+) strand; PAM type: NRG; PAM sequence: TGG
ggacaagggtacctgcgtgc

SEQ ID NO: 13100 - DNA, 20 bp, Artificial Sequence
  Description of Artificial Sequence: Synthetic oligonucleotide
  Target: AGXT; (+) strand; PAM type: NRG; PAM sequence: GAG
acaagggtacctgcgtgctg

SEQ ID NO: 13101 - DNA, 20 bp, Artificial Sequence
  Description of Artificial Sequence: Synthetic oligonucleotide
  Target: AGXT; (+) strand; PAM type: NRG; PAM sequence: GAG
aagggtacctgcgtgctgga

SEQ ID NO: 13102 - DNA, 20 bp, Artificial Sequence
  Description of Artificial Sequence: Synthetic oligonucleotide
  Target: AGXT; (+) strand; PAM type: NRG; PAM sequence: CAG
cctgcgtgctggagagcgca

SEQ ID NO: 13103 - DNA, 20 bp, Artificial Sequence
  Description of Artificial Sequence: Synthetic oligonucleotide
  Target: AGXT; (+) strand; PAM type: NRG; PAM sequence: CAG
cgtgctggagagcgcacagc

SEQ ID NO: 13104 - DNA, 20 bp, Artificial Sequence
  Description of Artificial Sequence: Synthetic oligonucleotide
  Target: AGXT; (+) strand; PAM type: NRG; PAM sequence: AGG
gtgctggagagcgcacagcc

SEQ ID NO: 13105 - DNA, 20 bp, Artificial Sequence
  Description of Artificial Sequence: Synthetic oligonucleotide
  Target: AGXT; (+) strand; PAM type: NRG; PAM sequence: GAG
agagcgcacagccaggacct

SEQ ID NO: 13106 - DNA, 20 bp, Artificial Sequence
  Description of Artificial Sequence: Synthetic oligonucleotide
  Target: AGXT; (+) strand; PAM type: NRG; PAM sequence: TGG
ggacctgagcccatgacacg

SEQ ID NO: 13107 - DNA, 20 bp, Artificial Sequence
  Description of Artificial Sequence: Synthetic oligonucleotide
  Target: AGXT; (+) strand; PAM type: NRG; PAM sequence: AAG
cctgagcccatgacacgtgg

SEQ ID NO: 13108 - DNA, 20 bp, Artificial Sequence
  Description of Artificial Sequence: Synthetic oligonucleotide
  Target: AGXT; (+) strand; PAM type: NRG; PAM sequence: TGG
tgacacgtggaagcctccaa

SEQ ID NO: 13109 - DNA, 20 bp, Artificial Sequence
  Description of Artificial Sequence: Synthetic oligonucleotide
  Target: AGXT; (+) strand; PAM type: NRG; PAM sequence: AAG
cacgtggaagcctccaatgg

SEQ ID NO: 13110 - DNA, 20 bp, Artificial Sequence
  Description of Artificial Sequence: Synthetic oligonucleotide
  Target: AGXT; (+) strand; PAM type: NRG; PAM sequence: AGG
acgtggaagcctccaatgga

SEQ ID NO: 13111 - DNA, 20 bp, Artificial Sequence
  Description of Artificial Sequence: Synthetic oligonucleotide
  Target: AGXT; (+) strand; PAM type: NRG; PAM sequence: CAG
aggtcccctatgctcccatc

SEQ ID NO: 13112 - DNA, 20 bp, Artificial Sequence
  Description of Artificial Sequence: Synthetic oligonucleotide
  Target: AGXT; (+) strand; PAM type: NRG; PAM sequence: CAG
cccctatgctcccatccagc

SEQ ID NO: 13113 - DNA, 20 bp, Artificial Sequence
  Description of Artificial Sequence: Synthetic oligonucleotide
  Target: AGXT; (+) strand; PAM type: NRG; PAM sequence: TAG
ctgcctgacttctgtgacca

SEQ ID NO: 13114 - DNA, 20 bp, Artificial Sequence
  Description of Artificial Sequence: Synthetic oligonucleotide
  Target: AGXT; (+) strand; PAM type: NRG; PAM sequence: CAG
tgacttctgtgaccatagat

SEQ ID NO: 13115 - DNA, 20 bp, Artificial Sequence
  Description of Artificial Sequence: Synthetic oligonucleotide
  Target: AGXT; (+) strand; PAM type: NRG; PAM sequence: TGG
tctgtgaccatagatcagcc

SEQ ID NO: 13116 - DNA, 20 bp, Artificial Sequence
  Description of Artificial Sequence: Synthetic oligonucleotide
  Target: AGXT; (+) strand; PAM type: NRG; PAM sequence: CGG
tttatttatttattttgaaa

SEQ ID NO: 13117 - DNA, 20 bp, Artificial Sequence
  Description of Artificial Sequence: Synthetic oligonucleotide
  Target: AGXT; (+) strand; PAM type: NRG; PAM sequence: GAG
tatttatttattttgaaacg

SEQ ID NO: 13118 - DNA, 20 bp, Artificial Sequence
  Description of Artificial Sequence: Synthetic oligonucleotide
  Target: AGXT; (+) strand; PAM type: NRG; PAM sequence: CAG
ggagtttcactcttgttgcc

SEQ ID NO: 13119 - DNA, 20 bp, Artificial Sequence
  Description of Artificial Sequence: Synthetic oligonucleotide
  Target: AGXT; (+) strand; PAM type: NRG; PAM sequence: AGG
gagtttcactcttgttgccc

SEQ ID NO: 13120 - DNA, 20 bp, Artificial Sequence
  Description of Artificial Sequence: Synthetic oligonucleotide
  Target: AGXT; (+) strand; PAM type: NRG; PAM sequence: TGG
ttcactcttgttgcccaggc

SEQ ID NO: 13121 - DNA, 20 bp, Artificial Sequence
  Description of Artificial Sequence: Synthetic oligonucleotide
  Target: AGXT; (+) strand; PAM type: NRG; PAM sequence: GAG
cactcttgttgcccaggctg

SEQ ID NO: 13122 - DNA, 20 bp, Artificial Sequence
  Description of Artificial Sequence: Synthetic oligonucleotide
  Target: AGXT; (+) strand; PAM type: NRG; PAM sequence: CAG
ttgttgcccaggctggagtg

SEQ ID NO: 13123 - DNA, 20 bp, Artificial Sequence
  Description of Artificial Sequence: Synthetic oligonucleotide
  Target: AGXT; (+) strand; PAM type: NRG; PAM sequence: TGG
ttgcccaggctggagtgcag

SEQ ID NO: 13124 - DNA, 20 bp, Artificial Sequence
  Description of Artificial Sequence: Synthetic oligonucleotide
  Target: AGXT; (+) strand; PAM type: NRG; PAM sequence: CAG
ggagtgcagtggcacgatct

SEQ ID NO: 13125 - DNA, 20 bp, Artificial Sequence
  Description of Artificial Sequence: Synthetic oligonucleotide
  Target: AGXT; (+) strand; PAM type: NRG; PAM sequence: CGG
tcactacaacctccgcctcc

SEQ ID NO: 13126 - DNA, 20 bp, Artificial Sequence
  Description of Artificial Sequence: Synthetic oligonucleotide
  Target: AGXT; (+) strand; PAM type: NRG; PAM sequence: GGG
cactacaacctccgcctccc

SEQ ID NO: 13127 - DNA, 20 bp, Artificial Sequence
  Description of Artificial Sequence: Synthetic oligonucleotide
  Target: AGXT; (+) strand; PAM type: NRG; PAM sequence: AAG
aacctccgcctcccgggttc

SEQ ID NO: 13128 - DNA, 20 bp, Artificial Sequence
  Description of Artificial Sequence: Synthetic oligonucleotide
  Target: AGXT; (+) strand; PAM type: NRG; PAM sequence: CAG
ttcaagcgattctcctgcct

SEQ ID NO: 13129 - DNA, 20 bp, Artificial Sequence
  Description of Artificial Sequence: Synthetic oligonucleotide
  Target: AGXT; (+) strand; PAM type: NRG; PAM sequence: AGG
tcaagcgattctcctgcctc

SEQ ID NO: 13130 - DNA, 20 bp, Artificial Sequence
  Description of Artificial Sequence: Synthetic oligonucleotide
  Target: AGXT; (+) strand; PAM type: NRG; PAM sequence: CGG
gattctcctgcctcaggctc

SEQ ID NO: 13131 - DNA, 20 bp, Artificial Sequence
  Description of Artificial Sequence: Synthetic oligonucleotide
  Target: AGXT; (+) strand; PAM type: NRG; PAM sequence: TAG
tcctgcctcaggctccggat

SEQ ID NO: 13132 - DNA, 20 bp, Artificial Sequence
  Description of Artificial Sequence: Synthetic oligonucleotide
  Target: AGXT; (+) strand; PAM type: NRG; PAM sequence: TGG
gcctcaggctccggattagc

SEQ ID NO: 13133 - DNA, 20 bp, Artificial Sequence
  Description of Artificial Sequence: Synthetic oligonucleotide
  Target: AGXT; (+) strand; PAM type: NRG; PAM sequence: GGG
cctcaggctccggattagct

SEQ ID NO: 13134 - DNA, 20 bp, Artificial Sequence
  Description of Artificial Sequence: Synthetic oligonucleotide
  Target: AGXT; (+) strand; PAM type: NRG; PAM sequence: CAG
ctccggattagctgggacta

SEQ ID NO: 13135 - DNA, 20 bp, Artificial Sequence
  Description of Artificial Sequence: Synthetic oligonucleotide
  Target: AGXT; (+) strand; PAM type: NRG; PAM sequence: AGG
tccggattagctgggactac

SEQ ID NO: 13136 - DNA, 20 bp, Artificial Sequence
  Description of Artificial Sequence: Synthetic oligonucleotide
  Target: AGXT; (+) strand; PAM type: NRG; PAM sequence: CGG
caggtgtgcaccaccatgcc

SEQ ID NO: 13137 - DNA, 20 bp, Artificial Sequence
  Description of Artificial Sequence: Synthetic oligonucleotide
  Target: AGXT; (+) strand; PAM type: NRG; PAM sequence: TAG
ccggctaatttttgtatttt

SEQ ID NO: 13138 - DNA, 20 bp, Artificial Sequence
  Description of Artificial Sequence: Synthetic oligonucleotide
  Target: AGXT; (+) strand; PAM type: NRG; PAM sequence: CAG
taatttttgtatttttagta

SEQ ID NO: 13139 - DNA, 20 bp, Artificial Sequence
  Description of Artificial Sequence: Synthetic oligonucleotide
  Target: AGXT; (+) strand; PAM type: NRG; PAM sequence: TGG
ttttgtatttttagtacaga

SEQ ID NO: 13140 - DNA, 20 bp, Artificial Sequence
  Description of Artificial Sequence: Synthetic oligonucleotide
  Target: AGXT; (+) strand; PAM type: NRG; PAM sequence: GGG
tttgtatttttagtacagat

SEQ ID NO: 13141 - DNA, 20 bp, Artificial Sequence
  Description of Artificial Sequence: Synthetic oligonucleotide
  Target: AGXT; (+) strand; PAM type: NRG; PAM sequence: GGG
ttgtatttttagtacagatg

SEQ ID NO: 13142 - DNA, 20 bp, Artificial Sequence
  Description of Artificial Sequence: Synthetic oligonucleotide
  Target: AGXT; (+) strand; PAM type: NRG; PAM sequence: TGG
cagatggggtttcactatat

SEQ ID NO: 13143 - DNA, 20 bp, Artificial Sequence
  Description of Artificial Sequence: Synthetic oligonucleotide
  Target: AGXT; (+) strand; PAM type: NRG; PAM sequence: CAG
tggggtttcactatattggc

SEQ ID NO: 13144 - DNA, 20 bp, Artificial Sequence
  Description of Artificial Sequence: Synthetic oligonucleotide
  Target: AGXT; (+) strand; PAM type: NRG; PAM sequence: AGG
ggggtttcactatattggcc

SEQ ID NO: 13145 - DNA, 20 bp, Artificial Sequence
  Description of Artificial Sequence: Synthetic oligonucleotide
  Target: AGXT; (+) strand; PAM type: NRG; PAM sequence: TGG
tttcactatattggccaggc

SEQ ID NO: 13146 - DNA, 20 bp, Artificial Sequence
  Description of Artificial Sequence: Synthetic oligonucleotide
  Target: AGXT; (+) strand; PAM type: NRG; PAM sequence: AAG
ggtctcgaactcctgacctc

SEQ ID NO: 13147 - DNA, 20 bp, Artificial Sequence
  Description of Artificial Sequence: Synthetic oligonucleotide
  Target: AGXT; (+) strand; PAM type: NRG; PAM sequence: CGG
ctcaagtgatccacctgcct

SEQ ID NO: 13148 - DNA, 20 bp, Artificial Sequence
  Description of Artificial Sequence: Synthetic oligonucleotide
  Target: AGXT; (+) strand; PAM type: NRG; PAM sequence: AAG
ccacctgcctcggcctccca

SEQ ID NO: 13149 - DNA, 20 bp, Artificial Sequence
  Description of Artificial Sequence: Synthetic oligonucleotide
  Target: AGXT; (+) strand; PAM type: NRG; PAM sequence: TGG
gcctcggcctcccaaagtgc

SEQ ID NO: 13150 - DNA, 20 bp, Artificial Sequence
  Description of Artificial Sequence: Synthetic oligonucleotide
  Target: AGXT; (+) strand; PAM type: NRG; PAM sequence: GGG
cctcggcctcccaaagtgct

SEQ ID NO: 13151 - DNA, 20 bp, Artificial Sequence
  Description of Artificial Sequence: Synthetic oligonucleotide
  Target: AGXT; (+) strand; PAM type: NRG; PAM sequence: AAG
tcccaaagtgctgggattac

SEQ ID NO: 13152 - DNA, 20 bp, Artificial Sequence
  Description of Artificial Sequence: Synthetic oligonucleotide
  Target: AGXT; (+) strand; PAM type: NRG; PAM sequence: GAG
agtgctgggattacaagcgt

SEQ ID NO: 13153 - DNA, 20 bp, Artificial Sequence
  Description of Artificial Sequence: Synthetic oligonucleotide
  Target: AGXT; (+) strand; PAM type: NRG; PAM sequence: CAG
caagcgtgagccactgtgcc

SEQ ID NO: 13154 - DNA, 20 bp, Artificial Sequence
  Description of Artificial Sequence: Synthetic oligonucleotide
  Target: AGXT; (+) strand; PAM type: NRG; PAM sequence: TAG
tgagccactgtgcccagcca

SEQ ID NO: 13155 - DNA, 20 bp, Artificial Sequence
  Description of Artificial Sequence: Synthetic oligonucleotide
  Target: AGXT; (+) strand; PAM type: NRG; PAM sequence: TGG
ccagccatagttgaatttca

SEQ ID NO: 13156 - DNA, 20 bp, Artificial Sequence
  Description of Artificial Sequence: Synthetic oligonucleotide
  Target: AGXT; (+) strand; PAM type: NRG; PAM sequence: CAG
ccatagttgaatttcatggt

SEQ ID NO: 13157 - DNA, 20 bp, Artificial Sequence
  Description of Artificial Sequence: Synthetic oligonucleotide
  Target: AGXT; (+) strand; PAM type: NRG; PAM sequence: TGG
tagttgaatttcatggtcag

SEQ ID NO: 13158 - DNA, 20 bp, Artificial Sequence
  Description of Artificial Sequence: Synthetic oligonucleotide
  Target: AGXT; (+) strand; PAM type: NRG; PAM sequence: CAG
ttcatggtcagtggaacaca

SEQ ID NO: 13159 - DNA, 20 bp, Artificial Sequence
  Description of Artificial Sequence: Synthetic oligonucleotide
  Target: AGXT; (+) strand; PAM type: NRG; PAM sequence: CAG
atggtcagtggaacacacag

SEQ ID NO: 13160 - DNA, 20 bp, Artificial Sequence
  Description of Artificial Sequence: Synthetic oligonucleotide
  Target: AGXT; (+) strand; PAM type: NRG; PAM sequence: AGG
tggtcagtggaacacacagc

SEQ ID NO: 13161 - DNA, 20 bp, Artificial Sequence
  Description of Artificial Sequence: Synthetic oligonucleotide
  Target: AGXT; (+) strand; PAM type: NRG; PAM sequence: CAG
cagcaggtcctccactgtgc

SEQ ID NO: 13162 - DNA, 20 bp, Artificial Sequence
  Description of Artificial Sequence: Synthetic oligonucleotide
  Target: AGXT; (+) strand; PAM type: NRG; PAM sequence: TGG
gacactcacatgtaccgtcg

SEQ ID NO: 13163 - DNA, 20 bp, Artificial Sequence
  Description of Artificial Sequence: Synthetic oligonucleotide
  Target: AGXT; (+) strand; PAM type: NRG; PAM sequence: GGG
acactcacatgtaccgtcgt

SEQ ID NO: 13164 - DNA, 20 bp, Artificial Sequence
  Description of Artificial Sequence: Synthetic oligonucleotide
  Target: AGXT; (+) strand; PAM type: NRG; PAM sequence: CGG
acatgtaccgtcgtgggcgc

SEQ ID NO: 13165 - DNA, 20 bp, Artificial Sequence
  Description of Artificial Sequence: Synthetic oligonucleotide
  Target: AGXT; (+) strand; PAM type: NRG; PAM sequence: GAG
gccggtgtgtctttgttgct

SEQ ID NO: 13166 - DNA, 20 bp, Artificial Sequence
  Description of Artificial Sequence: Synthetic oligonucleotide
  Target: AGXT; (+) strand; PAM type: NRG; PAM sequence: TGG
ctgagtgccgtcccgtcata

SEQ ID NO: 13167 - DNA, 20 bp, Artificial Sequence
  Description of Artificial Sequence: Synthetic oligonucleotide
  Target: AGXT; (+) strand; PAM type: NRG; PAM sequence: TGG
cgtcatatggacgtgcgtcg

SEQ ID NO: 13168 - DNA, 20 bp, Artificial Sequence
  Description of Artificial Sequence: Synthetic oligonucleotide
  Target: AGXT; (+) strand; PAM type: NRG; PAM sequence: GGG
gtcatatggacgtgcgtcgt

SEQ ID NO: 13169 - DNA, 20 bp, Artificial Sequence
  Description of Artificial Sequence: Synthetic oligonucleotide
  Target: AGXT; (+) strand; PAM type: NRG; PAM sequence: CGG
tggacgtgcgtcgtgggcgc

SEQ ID NO: 13170 - DNA, 20 bp, Artificial Sequence
  Description of Artificial Sequence: Synthetic oligonucleotide
  Target: AGXT; (+) strand; PAM type: NRG; PAM sequence: GAG
cgccggtgtgtcttgttgct

SEQ ID NO: 13171 - DNA, 20 bp, Artificial Sequence
  Description of Artificial Sequence: Synthetic oligonucleotide
  Target: AGXT; (+) strand; PAM type: NRG; PAM sequence: TGG
ctgagtgccgtcccgtcata

SEQ ID NO: 13172 - DNA, 20 bp, Artificial Sequence
  Description of Artificial Sequence: Synthetic oligonucleotide
  Target: AGXT; (+) strand; PAM type: NRG; PAM sequence: TGG
atggacacctcatgatttgt

SEQ ID NO: 13173 - DNA, 20 bp, Artificial Sequence
  Description of Artificial Sequence: Synthetic oligonucleotide
  Target: AGXT; (+) strand; PAM type: NRG; PAM sequence: TAG
gatttgttggttcatcacca

SEQ ID NO: 13174 - DNA, 20 bp, Artificial Sequence
  Description of Artificial Sequence: Synthetic oligonucleotide
  Target: AGXT; (+) strand; PAM type: NRG; PAM sequence: GAG
gttggttcatcaccatagtt

SEQ ID NO: 13175 - DNA, 20 bp, Artificial Sequence
  Description of Artificial Sequence: Synthetic oligonucleotide
  Target: AGXT; (+) strand; PAM type: NRG; PAM sequence: TGG
catcaccatagttgagcatc

SEQ ID NO: 13176 - DNA, 20 bp, Artificial Sequence
  Description of Artificial Sequence: Synthetic oligonucleotide
  Target: AGXT; (+) strand; PAM type: NRG; PAM sequence: GGG
atcaccatagttgagcatct

SEQ ID NO: 13177 - DNA, 20 bp, Artificial Sequence
  Description of Artificial Sequence: Synthetic oligonucleotide
  Target: AGXT; (+) strand; PAM type: NRG; PAM sequence: TGG
catctgggttatttctattt

SEQ ID NO: 13178 - DNA, 20 bp, Artificial Sequence
  Description of Artificial Sequence: Synthetic oligonucleotide
  Target: AGXT; (+) strand; PAM type: NRG; PAM sequence: GGG
atctgggttatttctatttt

SEQ ID NO: 13179 - DNA, 20 bp, Artificial Sequence
  Description of Artificial Sequence: Synthetic oligonucleotide
  Target: AGXT; (+) strand; PAM type: NRG; PAM sequence: GGG
tctgggttatttctattttg

SEQ ID NO: 13180 - DNA, 20 bp, Artificial Sequence
  Description of Artificial Sequence: Synthetic oligonucleotide
  Target: AGXT; (+) strand; PAM type: NRG; PAM sequence: CGG
ttttggggctgttatgaata

SEQ ID NO: 13181 - DNA, 20 bp, Artificial Sequence
  Description of Artificial Sequence: Synthetic oligonucleotide
  Target: AGXT; (+) strand; PAM type: NRG; PAM sequence: GAG
ttggggctgttatgaatacg

SEQ ID NO: 13182 - DNA, 20 bp, Artificial Sequence
  Description of Artificial Sequence: Synthetic oligonucleotide
  Target: AGXT; (+) strand; PAM type: NRG; PAM sequence: AGG
tggggctgttatgaatacgg

SEQ ID NO: 13183 - DNA, 20 bp, Artificial Sequence
  Description of Artificial Sequence: Synthetic oligonucleotide
  Target: AGXT; (+) strand; PAM type: NRG; PAM sequence: TAG
ggctgttatgaatacggagg

SEQ ID NO: 13184 - DNA, 20 bp, Artificial Sequence
  Description of Artificial Sequence: Synthetic oligonucleotide
  Target: AGXT; (+) strand; PAM type: NRG; PAM sequence: AAG
aggtagtgaaattcttactc

SEQ ID NO: 13185 - DNA, 20 bp, Artificial Sequence
  Description of Artificial Sequence: Synthetic oligonucleotide
  Target: AGXT; (+) strand; PAM type: NRG; PAM sequence: TGG
ttcttactcaagccttcgtg

SEQ ID NO: 13186 - DNA, 20 bp, Artificial Sequence
  Description of Artificial Sequence: Synthetic oligonucleotide
  Target: AGXT; (+) strand; PAM type: NRG; PAM sequence: TGG
ccatatattttcatttttct

SEQ ID NO: 13187 - DNA, 20 bp, Artificial Sequence
  Description of Artificial Sequence: Synthetic oligonucleotide
  Target: AGXT; (+) strand; PAM type: NRG; PAM sequence: TAG
atttttcttggataaataac

SEQ ID NO: 13188 - DNA, 20 bp, Artificial Sequence
  Description of Artificial Sequence: Synthetic oligonucleotide
  Target: AGXT; (+) strand; PAM type: NRG; PAM sequence: AGG
tttttcttggataaataact

SEQ ID NO: 13189 - DNA, 20 bp, Artificial Sequence
  Description of Artificial Sequence: Synthetic oligonucleotide
  Target: AGXT; (+) strand; PAM type: NRG; PAM sequence: GAG
tttcttggataaataactag

SEQ ID NO: 13190 - DNA, 20 bp, Artificial Sequence
  Description of Artificial Sequence: Synthetic oligonucleotide
  Target: AGXT; (+) strand; PAM type: NRG; PAM sequence: TGG
cttggataaataactaggag

SEQ ID NO: 13191 - DNA, 20 bp, Artificial Sequence
  Description of Artificial Sequence: Synthetic oligonucleotide
  Target: AGXT; (+) strand; PAM type: NRG; PAM sequence: CAG
aataactaggagtggaattg

SEQ ID NO: 13192 - DNA, 20 bp, Artificial Sequence
  Description of Artificial Sequence: Synthetic oligonucleotide
  Target: AGXT; (+) strand; PAM type: NRG; PAM sequence: AGG
ataactaggagtggaattgc

SEQ ID NO: 13193 - DNA, 20 bp, Artificial Sequence
  Description of Artificial Sequence: Synthetic oligonucleotide
  Target: AGXT; (+) strand; PAM type: NRG; PAM sequence: GGG
taactaggagtggaattgca

SEQ ID NO: 13194 - DNA, 20 bp, Artificial Sequence
  Description of Artificial Sequence: Synthetic oligonucleotide
  Target: AGXT; (+) strand; PAM type: NRG; PAM sequence: TAG
ggaattgcagggtcatacaa

SEQ ID NO: 13195 - DNA, 20 bp, Artificial Sequence
  Description of Artificial Sequence: Synthetic oligonucleotide
  Target: AGXT; (+) strand; PAM type: NRG; PAM sequence: AGG
gaattgcagggtcatacaat

SEQ ID NO: 13196 - DNA, 20 bp, Artificial Sequence
  Description of Artificial Sequence: Synthetic oligonucleotide
  Target: AGXT; (+) strand; PAM type: NRG; PAM sequence: GAG
caataggcttaaccttatac

SEQ ID NO: 13197 - DNA, 20 bp, Artificial Sequence
  Description of Artificial Sequence: Synthetic oligonucleotide
  Target: AGXT; (+) strand; PAM type: NRG; PAM sequence: AAG
gactgccacgaaattctccg

SEQ ID NO: 13198 - DNA, 20 bp, Artificial Sequence
  Description of Artificial Sequence: Synthetic oligonucleotide
  Target: AGXT; (+) strand; PAM type: NRG; PAM sequence: TGG
tgccacgaaattctccgaag

SEQ ID NO: 13199 - DNA, 20 bp, Artificial Sequence
  Description of Artificial Sequence: Synthetic oligonucleotide
  Target: AGXT; (+) strand; PAM type: NRG; PAM sequence: CAG
tcttccatgtttcattcccg

SEQ ID NO: 13200 - DNA, 20 bp, Artificial Sequence
  Description of Artificial Sequence: Synthetic oligonucleotide
  Target: AGXT; (+) strand; PAM type: NRG; PAM sequence: CAG
atgtttcattcccgcagcta

SEQ ID NO: 13201 - DNA, 20 bp, Artificial Sequence
  Description of Artificial Sequence: Synthetic oligonucleotide
  Target: AGXT; (+) strand; PAM type: NRG; PAM sequence: CAG
attcccgcagctacagcgtc

SEQ ID NO: 13202 - DNA, 20 bp, Artificial Sequence
  Description of Artificial Sequence: Synthetic oligonucleotide
  Target: AGXT; (+) strand; PAM type: NRG; PAM sequence: AGG
ttcccgcagctacagcgtcc

SEQ ID NO: 13203 - DNA, 20 bp, Artificial Sequence
  Description of Artificial Sequence: Synthetic oligonucleotide
  Target: AGXT; (+) strand; PAM type: NRG; PAM sequence: GGG
tcccgcagctacagcgtcca

SEQ ID NO: 13204 - DNA, 20 bp, Artificial Sequence
  Description of Artificial Sequence: Synthetic oligonucleotide
  Target: AGXT; (+) strand; PAM type: NRG; PAM sequence: TAG
tccatgttgtctttttttgc

SEQ ID NO: 13205 - DNA, 20 bp, Artificial Sequence
  Description of Artificial Sequence: Synthetic oligonucleotide
  Target: AGXT; (+) strand; PAM type: NRG; PAM sequence: AGG
ccatgttgtctttttttgct

SEQ ID NO: 13206 - DNA, 20 bp, Artificial Sequence
  Description of Artificial Sequence: Synthetic oligonucleotide
  Target: AGXT; (+) strand; PAM type: NRG; PAM sequence: GGG
catgttgtctttttttgcta

SEQ ID NO: 13207 - DNA, 20 bp, Artificial Sequence
  Description of Artificial Sequence: Synthetic oligonucleotide
  Target: AGXT; (+) strand; PAM type: NRG; PAM sequence: GGG
atgttgtctttttttgctag

SEQ ID NO: 13208 - DNA, 20 bp, Artificial Sequence
  Description of Artificial Sequence: Synthetic oligonucleotide
  Target: AGXT; (+) strand; PAM type: NRG; PAM sequence: GGG
tgttgtctttttttgctagg

SEQ ID NO: 13209 - DNA, 20 bp, Artificial Sequence
  Description of Artificial Sequence: Synthetic oligonucleotide
  Target: AGXT; (+) strand; PAM type: NRG; PAM sequence: TGG
gtgtaaaatcctgtctgatt

SEQ ID NO: 13210 - DNA, 20 bp, Artificial Sequence
  Description of Artificial Sequence: Synthetic oligonucleotide
  Target: AGXT; (+) strand; PAM type: NRG; PAM sequence: TAG
aatcctgtctgatttggttt

SEQ ID NO: 13211 - DNA, 20 bp, Artificial Sequence
  Description of Artificial Sequence: Synthetic oligonucleotide
  Target: AGXT; (+) strand; PAM type: NRG; PAM sequence: GAG
ccctgatgcctattgatgtt

SEQ ID NO: 13212 - DNA, 20 bp, Artificial Sequence
  Description of Artificial Sequence: Synthetic oligonucleotide
  Target: AGXT; (+) strand; PAM type: NRG; PAM sequence: GAG
gatgttgagcaacttctcat

SEQ ID NO: 13213 - DNA, 20 bp, Artificial Sequence
  Description of Artificial Sequence: Synthetic oligonucleotide
  Target: AGXT; (+) strand; PAM type: NRG; PAM sequence: CGG
agcaacttctcatgagctat

SEQ ID NO: 13214 - DNA, 20 bp, Artificial Sequence
  Description of Artificial Sequence: Synthetic oligonucleotide
  Target: AGXT; (+) strand; PAM type: NRG; PAM sequence: TAG
catgagctatcggccgtttg

SEQ ID NO: 13215 - DNA, 20 bp, Artificial Sequence
  Description of Artificial Sequence: Synthetic oligonucleotide
  Target: AGXT; (+) strand; PAM type: NRG; PAM sequence: AAG
ccgtttgtagatcttctgaa

SEQ ID NO: 13216 - DNA, 20 bp, Artificial Sequence
  Description of Artificial Sequence: Synthetic oligonucleotide
  Target: AGXT; (+) strand; PAM type: NRG; PAM sequence: CAG
gtagatcttctgaaaagtgt

SEQ ID NO: 13217 - DNA, 20 bp, Artificial Sequence
  Description of Artificial Sequence: Synthetic oligonucleotide
  Target: AGXT; (+) strand; PAM type: NRG; PAM sequence: TGG
tcaaatattttgttcatatt

SEQ ID NO: 13218 - DNA, 20 bp, Artificial Sequence
  Description of Artificial Sequence: Synthetic oligonucleotide
  Target: AGXT; (+) strand; PAM type: NRG; PAM sequence: TAG
gatcattttaaaatatattc

SEQ ID NO: 13219 - DNA, 20 bp, Artificial Sequence
  Description of Artificial Sequence: Synthetic oligonucleotide
  Target: AGXT; (+) strand; PAM type: NRG; PAM sequence: CAG
aaatatattctagatactat

SEQ ID NO: 13220 - DNA, 20 bp, Artificial Sequence
  Description of Artificial Sequence: Synthetic oligonucleotide
  Target: AGXT; (+) strand; PAM type: NRG; PAM sequence: TGG
tagatactatcagatacgtg

SEQ ID NO: 13221 - DNA, 20 bp, Artificial Sequence
  Description of Artificial Sequence: Synthetic oligonucleotide
  Target: AGXT; (+) strand; PAM type: NRG; PAM sequence: TGG
gaatatttcctccctctctg

SEQ ID NO: 13222 - DNA, 20 bp, Artificial Sequence
  Description of Artificial Sequence: Synthetic oligonucleotide
  Target: AGXT; (+) strand; PAM type: NRG; PAM sequence: GAG
tttttttttttttttttttt

SEQ ID NO: 13223 - DNA, 20 bp, Artificial Sequence
  Description of Artificial Sequence: Synthetic oligonucleotide
  Target: AGXT; (+) strand; PAM type: NRG; PAM sequence: AAG
ttttttttttttttttgaga

SEQ ID NO: 13224 - DNA, 20 bp, Artificial Sequence
  Description of Artificial Sequence: Synthetic oligonucleotide
  Target: AGXT; (+) strand; PAM type: NRG; PAM sequence: CAG
agaaagaatctcactccgtc

SEQ ID NO: 13225 - DNA, 20 bp, Artificial Sequence
  Description of Artificial Sequence: Synthetic oligonucleotide
  Target: AGXT; (+) strand; PAM type: NRG; PAM sequence: AGG
gaaagaatctcactccgtcc

SEQ ID NO: 13226 - DNA, 20 bp, Artificial Sequence
  Description of Artificial Sequence: Synthetic oligonucleotide
  Target: AGXT; (+) strand; PAM type: NRG; PAM sequence: TGG
gaatctcactccgtccaggc

SEQ ID NO: 13227 - DNA, 20 bp, Artificial Sequence
  Description of Artificial Sequence: Synthetic oligonucleotide
  Target: AGXT; (+) strand; PAM type: NRG; PAM sequence: GAG
atctcactccgtccaggctg

SEQ ID NO: 13228 - DNA, 20 bp, Artificial Sequence
  Description of Artificial Sequence: Synthetic oligonucleotide
  Target: AGXT; (+) strand; PAM type: NRG; PAM sequence: GAG
ctcactccgtccaggctgga

SEQ ID NO: 13229 - DNA, 20 bp, Artificial Sequence
  Description of Artificial Sequence: Synthetic oligonucleotide
  Target: AGXT; (+) strand; PAM type: NRG; PAM sequence: CAG
actccgtccaggctggagag

SEQ ID NO: 13230 - DNA, 20 bp, Artificial Sequence
  Description of Artificial Sequence: Synthetic oligonucleotide
  Target: AGXT; (+) strand; PAM type: NRG; PAM sequence: TGG
ccgtccaggctggagagcag

SEQ ID NO: 13231 - DNA, 20 bp, Artificial Sequence
  Description of Artificial Sequence: Synthetic oligonucleotide
  Target: AGXT; (+) strand; PAM type: NRG; PAM sequence: CAG
ggagagcagtggtgtgatct

SEQ ID NO: 13232 - DNA, 20 bp, Artificial Sequence
  Description of Artificial Sequence: Synthetic oligonucleotide
  Target: AGXT; (+) strand; PAM type: NRG; PAM sequence: CGG
tcactgcaacctccacctcc

SEQ ID NO: 13233 - DNA, 20 bp, Artificial Sequence
  Description of Artificial Sequence: Synthetic oligonucleotide
  Target: AGXT; (+) strand; PAM type: NRG; PAM sequence: GGG
cactgcaacctccacctccc

SEQ ID NO: 13234 - DNA, 20 bp, Artificial Sequence
  Description of Artificial Sequence: Synthetic oligonucleotide
  Target: AGXT; (+) strand; PAM type: NRG; PAM sequence: AAG
aacctccacctcccgggttc

SEQ ID NO: 13235 - DNA, 20 bp, Artificial Sequence
  Description of Artificial Sequence: Synthetic oligonucleotide
  Target: AGXT; (+) strand; PAM type: NRG; PAM sequence: GAG
cctccacctcccgggttcaa

SEQ ID NO: 13236 - DNA, 20 bp, Artificial Sequence
  Description of Artificial Sequence: Synthetic oligonucleotide
  Target: AGXT; (+) strand; PAM type: NRG; PAM sequence: CAG
ttcaagagattctcctgcct

SEQ ID NO: 13237 - DNA, 20 bp, Artificial Sequence
  Description of Artificial Sequence: Synthetic oligonucleotide
  Target: AGXT; (+) strand; PAM type: NRG; PAM sequence: AAG
ttctcctgcctcagcctccc

SEQ ID NO: 13238 - DNA, 20 bp, Artificial Sequence
  Description of Artificial Sequence: Synthetic oligonucleotide
  Target: AGXT; (+) strand; PAM type: NRG; PAM sequence: TAG
tcctgcctcagcctcccaag

SEQ ID NO: 13239 - DNA, 20 bp, Artificial Sequence
  Description of Artificial Sequence: Synthetic oligonucleotide
  Target: AGXT; (+) strand; PAM type: NRG; PAM sequence: TGG
gcctcagcctcccaagtagc

SEQ ID NO: 13240 - DNA, 20 bp, Artificial Sequence
  Description of Artificial Sequence: Synthetic oligonucleotide
  Target: AGXT; (+) strand; PAM type: NRG; PAM sequence: GGG
cctcagcctcccaagtagct

SEQ ID NO: 13241 - DNA, 20 bp, Artificial Sequence
  Description of Artificial Sequence: Synthetic oligonucleotide
  Target: AGXT; (+) strand; PAM type: NRG; PAM sequence: CAG
ctcccaagtagctgggatta

SEQ ID NO: 13242 - DNA, 20 bp, Artificial Sequence
  Description of Artificial Sequence: Synthetic oligonucleotide
  Target: AGXT; (+) strand; PAM type: NRG; PAM sequence: AGG
tcccaagtagctgggattac

SEQ ID NO: 13243 - DNA, 20 bp, Artificial Sequence
  Description of Artificial Sequence: Synthetic oligonucleotide
  Target: AGXT; (+) strand; PAM type: NRG; PAM sequence: CGG
caggcatgcaccaccacacc

SEQ ID NO: 13244 - DNA, 20 bp, Artificial Sequence
  Description of Artificial Sequence: Synthetic oligonucleotide
  Target: AGXT; (+) strand; PAM type: NRG; PAM sequence: TAG
ctaatttttgtgtttttttg

SEQ ID NO: 13245 - DNA, 20 bp, Artificial Sequence
  Description of Artificial Sequence: Synthetic oligonucleotide
  Target: AGXT; (+) strand; PAM type: NRG; PAM sequence: GAG
aatttttgtgtttttttgta

SEQ ID NO: 13246 - DNA, 20 bp, Artificial Sequence
  Description of Artificial Sequence: Synthetic oligonucleotide
  Target: AGXT; (+) strand; PAM type: NRG; PAM sequence: CGG
tttgtgtttttttgtagaga

SEQ ID NO: 13247 - DNA, 20 bp, Artificial Sequence
  Description of Artificial Sequence: Synthetic oligonucleotide
  Target: AGXT; (+) strand; PAM type: NRG; PAM sequence: GGG
ttgtgtttttttgtagagac

SEQ ID NO: 13248 - DNA, 20 bp, Artificial Sequence
  Description of Artificial Sequence: Synthetic oligonucleotide
  Target: AGXT; (+) strand; PAM type: NRG; PAM sequence: GGG
tgtgtttttttgtagagacg

SEQ ID NO: 13249 - DNA, 20 bp, Artificial Sequence
  Description of Artificial Sequence: Synthetic oligonucleotide
  Target: AGXT; (+) strand; PAM type: NRG; PAM sequence: TGG
gagacggggttttgccatgt

SEQ ID NO: 13250 - DNA, 20 bp, Artificial Sequence
  Description of Artificial Sequence: Synthetic oligonucleotide
  Target: AGXT; (+) strand; PAM type: NRG; PAM sequence: CAG
cggggttttgccatgttggc

SEQ ID NO: 13251 - DNA, 20 bp, Artificial Sequence
  Description of Artificial Sequence: Synthetic oligonucleotide
  Target: AGXT; (+) strand; PAM type: NRG; PAM sequence: AGG
ggggttttgccatgttggcc

SEQ ID NO: 13252 - DNA, 20 bp, Artificial Sequence
  Description of Artificial Sequence: Synthetic oligonucleotide
  Target: AGXT; (+) strand; PAM type: NRG; PAM sequence: TGG
ttttgccatgttggccaggc

SEQ ID NO: 13253 - DNA, 20 bp, Artificial Sequence
  Description of Artificial Sequence: Synthetic oligonucleotide
  Target: AGXT; (+) strand; PAM type: NRG; PAM sequence: AAG
ggtctcaaattcctgacctc

SEQ ID NO: 13254 - DNA, 20 bp, Artificial Sequence
  Description of Artificial Sequence: Synthetic oligonucleotide
  Target: AGXT; (+) strand; PAM type: NRG; PAM sequence: CAG
ctcaagtgatccacccacct

SEQ ID NO: 13255 - DNA, 20 bp, Artificial Sequence
  Description of Artificial Sequence: Synthetic oligonucleotide
  Target: AGXT; (+) strand; PAM type: NRG; PAM sequence: AAG
ccacccacctcagcctccca

SEQ ID NO: 13256 - DNA, 20 bp, Artificial Sequence
  Description of Artificial Sequence: Synthetic oligonucleotide
  Target: AGXT; (+) strand; PAM type: NRG; PAM sequence: TGG
acctcagcctcccaaagtgc

SEQ ID NO: 13257 - DNA, 20 bp, Artificial Sequence
  Description of Artificial Sequence: Synthetic oligonucleotide
  Target: AGXT; (+) strand; PAM type: NRG; PAM sequence: GGG
cctcagcctcccaaagtgct

SEQ ID NO: 13258 - DNA, 20 bp, Artificial Sequence
  Description of Artificial Sequence: Synthetic oligonucleotide
  Target: AGXT; (+) strand; PAM type: NRG; PAM sequence: CAG
ctcccaaagtgctgggatta

SEQ ID NO: 13259 - DNA, 20 bp, Artificial Sequence
  Description of Artificial Sequence: Synthetic oligonucleotide
  Target: AGXT; (+) strand; PAM type: NRG; PAM sequence: AGG
tcccaaagtgctgggattac

SEQ ID NO: 13260 - DNA, 20 bp, Artificial Sequence
  Description of Artificial Sequence: Synthetic oligonucleotide
  Target: AGXT; (+) strand; PAM type: NRG; PAM sequence: GAG
agtgctgggattacaggcat

SEQ ID NO: 13261 - DNA, 20 bp, Artificial Sequence
  Description of Artificial Sequence: Synthetic oligonucleotide
  Target: AGXT; (+) strand; PAM type: NRG; PAM sequence: CAG
caggcatgagccaccacacc

SEQ ID NO: 13262 - DNA, 20 bp, Artificial Sequence
  Description of Artificial Sequence: Synthetic oligonucleotide
  Target: AGXT; (+) strand; PAM type: NRG; PAM sequence: AAG
tttcttaattgtgtctttca

SEQ ID NO: 13263 - DNA, 20 bp, Artificial Sequence
  Description of Artificial Sequence: Synthetic oligonucleotide
  Target: AGXT; (+) strand; PAM type: NRG; PAM sequence: GAG
tcttaattgtgtctttcaaa

SEQ ID NO: 13264 - DNA, 20 bp, Artificial Sequence
  Description of Artificial Sequence: Synthetic oligonucleotide
  Target: AGXT; (+) strand; PAM type: NRG; PAM sequence: CAG
taattgtgtctttcaaagag

SEQ ID NO: 13265 - DNA, 20 bp, Artificial Sequence
  Description of Artificial Sequence: Synthetic oligonucleotide
  Target: AGXT; (+) strand; PAM type: NRG; PAM sequence: AGG
aattgtgtctttcaaagagc

SEQ ID NO: 13266 - DNA, 20 bp, Artificial Sequence
  Description of Artificial Sequence: Synthetic oligonucleotide
  Target: AGXT; (+) strand; PAM type: NRG; PAM sequence: TGG
agagcaggtattttcaattt

SEQ ID NO: 13267 - DNA, 20 bp, Artificial Sequence
  Description of Artificial Sequence: Synthetic oligonucleotide
  Target: AGXT; (+) strand; PAM type: NRG; PAM sequence: AAG
aggtattttcaattttggtg

SEQ ID NO: 13268 - DNA, 20 bp, Artificial Sequence
  Description of Artificial Sequence: Synthetic oligonucleotide
  Target: AGXT; (+) strand; PAM type: NRG; PAM sequence: GAG
gtgaagtcgtatttatgaat

SEQ ID NO: 13269 - DNA, 20 bp, Artificial Sequence
  Description of Artificial Sequence: Synthetic oligonucleotide
  Target: AGXT; (+) strand; PAM type: NRG; PAM sequence: TGG
tatgaatgagtttttttcta

SEQ ID NO: 13270 - DNA, 20 bp, Artificial Sequence
  Description of Artificial Sequence: Synthetic oligonucleotide
  Target: AGXT; (+) strand; PAM type: NRG; PAM sequence: TGG
atgagtttttttctatggtc

SEQ ID NO: 13271 - DNA, 20 bp, Artificial Sequence
  Description of Artificial Sequence: Synthetic oligonucleotide
  Target: AGXT; (+) strand; PAM type: NRG; PAM sequence: GGG
tgagtttttttctatggtct

SEQ ID NO: 13272 - DNA, 20 bp, Artificial Sequence
  Description of Artificial Sequence: Synthetic oligonucleotide
  Target: AGXT; (+) strand; PAM type: NRG; PAM sequence: AAG
gggctgtttgtatcttgtct

SEQ ID NO: 13273 - DNA, 20 bp, Artificial Sequence
  Description of Artificial Sequence: Synthetic oligonucleotide
  Target: AGXT; (+) strand; PAM type: NRG; PAM sequence: GAG
aagaaacctttgcctacttt

SEQ ID NO: 13274 - DNA, 20 bp, Artificial Sequence
  Description of Artificial Sequence: Synthetic oligonucleotide
  Target: AGXT; (+) strand; PAM type: NRG; PAM sequence: AGG
agaaacctttgcctactttg

SEQ ID NO: 13275 - DNA, 20 bp, Artificial Sequence
  Description of Artificial Sequence: Synthetic oligonucleotide
  Target: AGXT; (+) strand; PAM type: NRG; PAM sequence: TGG
cctttgcctactttgaggtc

SEQ ID NO: 13276 - DNA, 20 bp, Artificial Sequence
  Description of Artificial Sequence: Synthetic oligonucleotide
  Target: AGXT; (+) strand; PAM type: NRG; PAM sequence: CGG
tgcctactttgaggtctgga

SEQ ID NO: 13277 - DNA, 20 bp, Artificial Sequence
  Description of Artificial Sequence: Synthetic oligonucleotide
  Target: AGXT; (+) strand; PAM type: NRG; PAM sequence: TAG
tatcttcctgtgttttcttc

SEQ ID NO: 13278 - DNA, 20 bp, Artificial Sequence
  Description of Artificial Sequence: Synthetic oligonucleotide
  Target: AGXT; (+) strand; PAM type: NRG; PAM sequence: CAG
gttttcttctagaaacttta

SEQ ID NO: 13279 - DNA, 20 bp, Artificial Sequence
  Description of Artificial Sequence: Synthetic oligonucleotide
  Target: AGXT; (+) strand; PAM type: NRG; PAM sequence: CAG
ttctagaaactttacagtgt

SEQ ID NO: 13280 - DNA, 20 bp, Artificial Sequence
  Description of Artificial Sequence: Synthetic oligonucleotide
  Target: AGXT; (+) strand; PAM type: NRG; PAM sequence: TAG
acagtgtcagcttttgtatt

SEQ ID NO: 13281 - DNA, 20 bp, Artificial Sequence
  Description of Artificial Sequence: Synthetic oligonucleotide
  Target: AGXT; (+) strand; PAM type: NRG; PAM sequence: AGG
cagtgtcagcttttgtattt

SEQ ID NO: 13282 - DNA, 20 bp, Artificial Sequence
  Description of Artificial Sequence: Synthetic oligonucleotide
  Target: AGXT; (+) strand; PAM type: NRG; PAM sequence: CAG
cctcatattaattttgtgca

SEQ ID NO: 13283 - DNA, 20 bp, Artificial Sequence
  Description of Artificial Sequence: Synthetic oligonucleotide
  Target: AGXT; (+) strand; PAM type: NRG; PAM sequence: TAG
tattaattttgtgcacagtg

SEQ ID NO: 13284 - DNA, 20 bp, Artificial Sequence
  Description of Artificial Sequence: Synthetic oligonucleotide
  Target: AGXT; (+) strand; PAM type: NRG; PAM sequence: AAG
aattttgtgcacagtgtaga

SEQ ID NO: 13285 - DNA, 20 bp, Artificial Sequence
  Description of Artificial Sequence: Synthetic oligonucleotide
  Target: AGXT; (+) strand; PAM type: NRG; PAM sequence: AGG
attttgtgcacagtgtagaa

SEQ ID NO: 13286 - DNA, 20 bp, Artificial Sequence
  Description of Artificial Sequence: Synthetic oligonucleotide
  Target: AGXT; (+) strand; PAM type: NRG; PAM sequence: GGG
ttttgtgcacagtgtagaaa

SEQ ID NO: 13287 - DNA, 20 bp, Artificial Sequence
  Description of Artificial Sequence: Synthetic oligonucleotide
  Target: AGXT; (+) strand; PAM type: NRG; PAM sequence: GGG
tttgtgcacagtgtagaaag

SEQ ID NO: 13288 - DNA, 20 bp, Artificial Sequence
  Description of Artificial Sequence: Synthetic oligonucleotide
  Target: AGXT; (+) strand; PAM type: NRG; PAM sequence: GGG
ttgtgcacagtgtagaaagg

SEQ ID NO: 13289 - DNA, 20 bp, Artificial Sequence
  Description of Artificial Sequence: Synthetic oligonucleotide
  Target: AGXT; (+) strand; PAM type: NRG; PAM sequence: AAG
cacagtgtagaaagggggtc

SEQ ID NO: 13290 - DNA, 20 bp, Artificial Sequence
  Description of Artificial Sequence: Synthetic oligonucleotide
  Target: AGXT; (+) strand; PAM type: NRG; PAM sequence: AGG
acagtgtagaaagggggtca

SEQ ID NO: 13291 - DNA, 20 bp, Artificial Sequence
  Description of Artificial Sequence: Synthetic oligonucleotide
  Target: AGXT; (+) strand; PAM type: NRG; PAM sequence: CAG
ttttatccatactgatatcc

SEQ ID NO: 13292 - DNA, 20 bp, Artificial Sequence
  Description of Artificial Sequence: Synthetic oligonucleotide
  Target: AGXT; (+) strand; PAM type: NRG; PAM sequence: CAG
ccatactgatatcccagttc

SEQ ID NO: 13293 - DNA, 20 bp, Artificial Sequence
  Description of Artificial Sequence: Synthetic oligonucleotide
  Target: AGXT; (+) strand; PAM type: NRG; PAM sequence: CAG
ttccagtaacgtttgttaaa

SEQ ID NO: 13294 - DNA, 20 bp, Artificial Sequence
  Description of Artificial Sequence: Synthetic oligonucleotide
  Target: AGXT; (+) strand; PAM type: NRG; PAM sequence: CAG
ttgacaactttgttaaaaat

SEQ ID NO: 13295 - DNA, 20 bp, Artificial Sequence
  Description of Artificial Sequence: Synthetic oligonucleotide
  Target: AGXT; (+) strand; PAM type: NRG; PAM sequence: TAG
atcagttgactacacattca

SEQ ID NO: 13296 - DNA, 20 bp, Artificial Sequence
  Description of Artificial Sequence: Synthetic oligonucleotide
  Target: AGXT; (+) strand; PAM type: NRG; PAM sequence: AGG
tcagttgactacacattcat

SEQ ID NO: 13297 - DNA, 20 bp, Artificial Sequence
  Description of Artificial Sequence: Synthetic oligonucleotide
  Target: AGXT; (+) strand; PAM type: NRG; PAM sequence: CAG
cacattcataggtctattta

SEQ ID NO: 13298 - DNA, 20 bp, Artificial Sequence
  Description of Artificial Sequence: Synthetic oligonucleotide
  Target: AGXT; (+) strand; PAM type: NRG; PAM sequence: TAG
ccatgctgttgcaaatattg

SEQ ID NO: 13299 - DNA, 20 bp, Artificial Sequence
  Description of Artificial Sequence: Synthetic oligonucleotide
  Target: AGXT; (+) strand; PAM type: NRG; PAM sequence: AAG
ttacaataactcttgaaatt

SEQ ID NO: 13300 - DNA, 20 bp, Artificial Sequence
  Description of Artificial Sequence: Synthetic oligonucleotide
  Target: AGXT; (+) strand; PAM type: NRG; PAM sequence: AAG
taactcttgaaattaagaac

SEQ ID NO: 13301 - DNA, 20 bp, Artificial Sequence
  Description of Artificial Sequence: Synthetic oligonucleotide
  Target: AGXT; (+) strand; PAM type: NRG; PAM sequence: AAG
caatgtttttctccctttta

SEQ ID NO: 13302 - DNA, 20 bp, Artificial Sequence
  Description of Artificial Sequence: Synthetic oligonucleotide
  Target: AGXT; (+) strand; PAM type: NRG; PAM sequence: AGG
aatgtttttctcccttttaa

SEQ ID NO: 13303 - DNA, 20 bp, Artificial Sequence
  Description of Artificial Sequence: Synthetic oligonucleotide
  Target: AGXT; (+) strand; PAM type: NRG; PAM sequence: TAG
ttgaatttctgtgtacgttt

SEQ ID NO: 13304 - DNA, 20 bp, Artificial Sequence
  Description of Artificial Sequence: Synthetic oligonucleotide
  Target: AGXT; (+) strand; PAM type: NRG; PAM sequence: CAG
attcatgttgtctatttctt

SEQ ID NO: 13305 - DNA, 20 bp, Artificial Sequence
  Description of Artificial Sequence: Synthetic oligonucleotide
  Target: AGXT; (+) strand; PAM type: NRG; PAM sequence: TAG
tgttgtctatttcttcagaa

SEQ ID NO: 13306 - DNA, 20 bp, Artificial Sequence
  Description of Artificial Sequence: Synthetic oligonucleotide
  Target: AGXT; (+) strand; PAM type: NRG; PAM sequence: TGG
agaatagcttgctgaaattt

SEQ ID NO: 13307 - DNA, 20 bp, Artificial Sequence
  Description of Artificial Sequence: Synthetic oligonucleotide
  Target: AGXT; (+) strand; PAM type: NRG; PAM sequence: TAG
atagcttgctgaaattttgg

SEQ ID NO: 13308 - DNA, 20 bp, Artificial Sequence
  Description of Artificial Sequence: Synthetic oligonucleotide
  Target: AGXT; (+) strand; PAM type: NRG; PAM sequence: AGG
tagcttgctgaaattttggt

SEQ ID NO: 13309 - DNA, 20 bp, Artificial Sequence
  Description of Artificial Sequence: Synthetic oligonucleotide
  Target: AGXT; (+) strand; PAM type: NRG; PAM sequence: AAG
ctgcaccaaatctatatatc

SEQ ID NO: 13310 - DNA, 20 bp, Artificial Sequence
  Description of Artificial Sequence: Synthetic oligonucleotide
  Target: AGXT; (+) strand; PAM type: NRG; PAM sequence: AAG
ccaaatctatatatcaagtt

SEQ ID NO: 13311 - DNA, 20 bp, Artificial Sequence
  Description of Artificial Sequence: Synthetic oligonucleotide
  Target: AGXT; (+) strand; PAM type: NRG; PAM sequence: AGG
caaatctatatatcaagtta

SEQ ID NO: 13312 - DNA, 20 bp, Artificial Sequence
  Description of Artificial Sequence: Synthetic oligonucleotide
  Target: AGXT; (+) strand; PAM type: NRG; PAM sequence: TGG
atatatcaagttaaggaaaa

SEQ ID NO: 13313 - DNA, 20 bp, Artificial Sequence
  Description of Artificial Sequence: Synthetic oligonucleotide
  Target: AGXT; (+) strand; PAM type: NRG; PAM sequence: AAG
agttaaggaaaatggaaata

SEQ ID NO: 13314 - DNA, 20 bp, Artificial Sequence
  Description of Artificial Sequence: Synthetic oligonucleotide
  Target: AGXT; (+) strand; PAM type: NRG; PAM sequence: CAG
tataaattccatttcacaaa

SEQ ID NO: 13315 - DNA, 20 bp, Artificial Sequence
  Description of Artificial Sequence: Synthetic oligonucleotide
  Target: AGXT; (+) strand; PAM type: NRG; PAM sequence: AAG
catttcacaaacagaaatgt

SEQ ID NO: 13316 - DNA, 20 bp, Artificial Sequence
  Description of Artificial Sequence: Synthetic oligonucleotide
  Target: AGXT; (+) strand; PAM type: NRG; PAM sequence: CAG
aagtattttaaaattacttt

SEQ ID NO: 13317 - DNA, 20 bp, Artificial Sequence
  Description of Artificial Sequence: Synthetic oligonucleotide
  Target: AGXT; (+) strand; PAM type: NRG; PAM sequence: TAG
attactttcagcaatgtttc

SEQ ID NO: 13318 - DNA, 20 bp, Artificial Sequence
  Description of Artificial Sequence: Synthetic oligonucleotide
  Target: AGXT; (+) strand; PAM type: NRG; PAM sequence: CAG
tgtttctagttttcaacata

SEQ ID NO: 13319 - DNA, 20 bp, Artificial Sequence
  Description of Artificial Sequence: Synthetic oligonucleotide
  Target: AGXT; (+) strand; PAM type: NRG; PAM sequence: AAG
ctagttttcaacatacagca

SEQ ID NO: 13320 - DNA, 20 bp, Artificial Sequence
  Description of Artificial Sequence: Synthetic oligonucleotide
  Target: AGXT; (+) strand; PAM type: NRG; PAM sequence: TGG
gttttcaacatacagcaaag

SEQ ID NO: 13321 - DNA, 20 bp, Artificial Sequence
  Description of Artificial Sequence: Synthetic oligonucleotide
  Target: AGXT; (+) strand; PAM type: NRG; PAM sequence: GGG
ttttcaacatacagcaaagt

SEQ ID NO: 13322 - DNA, 20 bp, Artificial Sequence
  Description of Artificial Sequence: Synthetic oligonucleotide
  Target: AGXT; (+) strand; PAM type: NRG; PAM sequence: GAG
ttcaacatacagcaaagtgg

SEQ ID NO: 13323 - DNA, 20 bp, Artificial Sequence
  Description of Artificial Sequence: Synthetic oligonucleotide
  Target: AGXT; (+) strand; PAM type: NRG; PAM sequence: AGG
tcaacatacagcaaagtggg

SEQ ID NO: 13324 - DNA, 20 bp, Artificial Sequence
  Description of Artificial Sequence: Synthetic oligonucleotide
  Target: AGXT; (+) strand; PAM type: NRG; PAM sequence: GGG
caacatacagcaaagtggga

SEQ ID NO: 13325 - DNA, 20 bp, Artificial Sequence
  Description of Artificial Sequence: Synthetic oligonucleotide
  Target: AGXT; (+) strand; PAM type: NRG; PAM sequence: GGG
aacatacagcaaagtgggag

SEQ ID NO: 13326 - DNA, 20 bp, Artificial Sequence
  Description of Artificial Sequence: Synthetic oligonucleotide
  Target: AGXT; (+) strand; PAM type: NRG; PAM sequence: GGG
acatacagcaaagtgggagg

SEQ ID NO: 13327 - DNA, 20 bp, Artificial Sequence
  Description of Artificial Sequence: Synthetic oligonucleotide
  Target: AGXT; (+) strand; PAM type: NRG; PAM sequence: AAG
aaagtgggagggggttattt

SEQ ID NO: 13328 - DNA, 20 bp, Artificial Sequence
  Description of Artificial Sequence: Synthetic oligonucleotide
  Target: AGXT; (+) strand; PAM type: NRG; PAM sequence: AGG
aagtgggagggggttattta

SEQ ID NO: 13329 - DNA, 20 bp, Artificial Sequence
  Description of Artificial Sequence: Synthetic oligonucleotide
  Target: AGXT; (+) strand; PAM type: NRG; PAM sequence: AAG
gggagggggttatttaagga

SEQ ID NO: 13330 - DNA, 20 bp, Artificial Sequence
  Description of Artificial Sequence: Synthetic oligonucleotide
  Target: AGXT; (+) strand; PAM type: NRG; PAM sequence: CAG
gggggttatttaaggaaagc

SEQ ID NO: 13331 - DNA, 20 bp, Artificial Sequence
  Description of Artificial Sequence: Synthetic oligonucleotide
  Target: AGXT; (+) strand; PAM type: NRG; PAM sequence: AGG
ggggttatttaaggaaagcc

SEQ ID NO: 13332 - DNA, 20 bp, Artificial Sequence
  Description of Artificial Sequence: Synthetic oligonucleotide
  Target: AGXT; (+) strand; PAM type: NRG; PAM sequence: CAG
tttaaggaaagccaggaacc

SEQ ID NO: 13333 - DNA, 20 bp, Artificial Sequence
  Description of Artificial Sequence: Synthetic oligonucleotide
  Target: AGXT; (+) strand; PAM type: NRG; PAM sequence: AGG
ttaaggaaagccaggaaccc

SEQ ID NO: 13334 - DNA, 20 bp, Artificial Sequence
  Description of Artificial Sequence: Synthetic oligonucleotide
  Target: AGXT; (+) strand; PAM type: NRG; PAM sequence: CAG
gaaagccaggaacccaggaa

SEQ ID NO: 13335 - DNA, 20 bp, Artificial Sequence
  Description of Artificial Sequence: Synthetic oligonucleotide
  Target: AGXT; (+) strand; PAM type: NRG; PAM sequence: AGG
aaagccaggaacccaggaac

SEQ ID NO: 13336 - DNA, 20 bp, Artificial Sequence
  Description of Artificial Sequence: Synthetic oligonucleotide
  Target: AGXT; (+) strand; PAM type: NRG; PAM sequence: AAG
ccaggaacccaggaacagga

SEQ ID NO: 13337 - DNA, 20 bp, Artificial Sequence
  Description of Artificial Sequence: Synthetic oligonucleotide
  Target: AGXT; (+) strand; PAM type: NRG; PAM sequence: CAG
gaacaggaaagccactgatc

SEQ ID NO: 13338 - DNA, 20 bp, Artificial Sequence
  Description of Artificial Sequence: Synthetic oligonucleotide
  Target: AGXT; (+) strand; PAM type: NRG; PAM sequence: CAG
ggaaagccactgatccagcc

SEQ ID NO: 13339 - DNA, 20 bp, Artificial Sequence
  Description of Artificial Sequence: Synthetic oligonucleotide
  Target: AGXT; (+) strand; PAM type: NRG; PAM sequence: AGG
gaaagccactgatccagccc

SEQ ID NO: 13340 - DNA, 20 bp, Artificial Sequence
  Description of Artificial Sequence: Synthetic oligonucleotide
  Target: AGXT; (+) strand; PAM type: NRG; PAM sequence: GAG
aagccactgatccagcccag

SEQ ID NO: 13341 - DNA, 20 bp, Artificial Sequence
  Description of Artificial Sequence: Synthetic oligonucleotide
  Target: AGXT; (+) strand; PAM type: NRG; PAM sequence: AGG
agccactgatccagcccagg

SEQ ID NO: 13342 - DNA, 20 bp, Artificial Sequence
  Description of Artificial Sequence: Synthetic oligonucleotide
  Target: AGXT; (+) strand; PAM type: NRG; PAM sequence: CAG
cactgatccagcccaggagg

SEQ ID NO: 13343 - DNA, 20 bp, Artificial Sequence
  Description of Artificial Sequence: Synthetic oligonucleotide
  Target: AGXT; (+) strand; PAM type: NRG; PAM sequence: AGG
actgatccagcccaggaggc

SEQ ID NO: 13344 - DNA, 20 bp, Artificial Sequence
  Description of Artificial Sequence: Synthetic oligonucleotide
  Target: AGXT; (+) strand; PAM type: NRG; PAM sequence: CAG
tccagcccaggaggcaggac

SEQ ID NO: 13345 - DNA, 20 bp, Artificial Sequence
  Description of Artificial Sequence: Synthetic oligonucleotide
  Target: AGXT; (+) strand; PAM type: NRG; PAM sequence: AGG
ccagcccaggaggcaggacc

SEQ ID NO: 13346 - DNA, 20 bp, Artificial Sequence
  Description of Artificial Sequence: Synthetic oligonucleotide
  Target: AGXT; (+) strand; PAM type: NRG; PAM sequence: CAG
gcccaggaggcaggaccagg

SEQ ID NO: 13347 - DNA, 20 bp, Artificial Sequence
  Description of Artificial Sequence: Synthetic oligonucleotide
  Target: AGXT; (+) strand; PAM type: NRG; PAM sequence: CGG
gcaggaccaggcagcctccc

SEQ ID NO: 13348 - DNA, 20 bp, Artificial Sequence
  Description of Artificial Sequence: Synthetic oligonucleotide
  Target: AGXT; (+) strand; PAM type: NRG; PAM sequence: CAG
caggcagcctccccggcccc

SEQ ID NO: 13349 - DNA, 20 bp, Artificial Sequence
  Description of Artificial Sequence: Synthetic oligonucleotide
  Target: AGXT; (+) strand; PAM type: NRG; PAM sequence: CGG
gcagcctccccggcccccag

SEQ ID NO: 13350 - DNA, 20 bp, Artificial Sequence
  Description of Artificial Sequence: Synthetic oligonucleotide
  Target: AGXT; (+) strand; PAM type: NRG; PAM sequence: AAG
ccagcggcccttctccctcc

SEQ ID NO: 13351 - DNA, 20 bp, Artificial Sequence
  Description of Artificial Sequence: Synthetic oligonucleotide
  Target: AGXT; (+) strand; PAM type: NRG; PAM sequence: TAG
gcggcccttctccctccaag

SEQ ID NO: 13352 - DNA, 20 bp, Artificial Sequence
  Description of Artificial Sequence: Synthetic oligonucleotide
  Target: AGXT; (+) strand; PAM type: NRG; PAM sequence: TGG
tccctccaagtagaacctcc

SEQ ID NO: 13353 - DNA, 20 bp, Artificial Sequence
  Description of Artificial Sequence: Synthetic oligonucleotide
  Target: AGXT; (+) strand; PAM type: NRG; PAM sequence: CAG
caagtagaacctcctggaaa

SEQ ID NO: 13354 - DNA, 20 bp, Artificial Sequence
  Description of Artificial Sequence: Synthetic oligonucleotide
  Target: AGXT; (+) strand; PAM type: NRG; PAM sequence: TGG
cctcctggaaacagcccact

SEQ ID NO: 13355 - DNA, 20 bp, Artificial Sequence
  Description of Artificial Sequence: Synthetic oligonucleotide
  Target: AGXT; (+) strand; PAM type: NRG; PAM sequence: GGG
ctcctggaaacagcccactt

SEQ ID NO: 13356 - DNA, 20 bp, Artificial Sequence
  Description of Artificial Sequence: Synthetic oligonucleotide
  Target: AGXT; (+) strand; PAM type: NRG; PAM sequence: TAG
ggaaacagcccacttgggcg

SEQ ID NO: 13357 - DNA, 20 bp, Artificial Sequence
  Description of Artificial Sequence: Synthetic oligonucleotide
  Target: AGXT; (+) strand; PAM type: NRG; PAM sequence: TAG
cttgggcgtagatcttttgt

SEQ ID NO: 13358 - DNA, 20 bp, Artificial Sequence
  Description of Artificial Sequence: Synthetic oligonucleotide
  Target: AGXT; (+) strand; PAM type: NRG; PAM sequence: TAG
tcttttgttagatttattcc

SEQ ID NO: 13359 - DNA, 20 bp, Artificial Sequence
  Description of Artificial Sequence: Synthetic oligonucleotide
  Target: AGXT; (+) strand; PAM type: NRG; PAM sequence: AGG
cttttgttagatttattcct

SEQ ID NO: 13360 - DNA, 20 bp, Artificial Sequence
  Description of Artificial Sequence: Synthetic oligonucleotide
  Target: AGXT; (+) strand; PAM type: NRG; PAM sequence: TGG
cttgttgatgctgttataaa

SEQ ID NO: 13361 - DNA, 20 bp, Artificial Sequence
  Description of Artificial Sequence: Synthetic oligonucleotide
  Target: AGXT; (+) strand; PAM type: NRG; PAM sequence: CAG
catttgaaaattttcatttc

SEQ ID NO: 13362 - DNA, 20 bp, Artificial Sequence
  Description of Artificial Sequence: Synthetic oligonucleotide
  Target: AGXT; (+) strand; PAM type: NRG; PAM sequence: AAG
tctgaccttcctaaattcac

SEQ ID NO: 13363 - DNA, 20 bp, Artificial Sequence
  Description of Artificial Sequence: Synthetic oligonucleotide
  Target: AGXT; (+) strand; PAM type: NRG; PAM sequence: AGG
ctgaccttcctaaattcaca

SEQ ID NO: 13364 - DNA, 20 bp, Artificial Sequence
  Description of Artificial Sequence: Synthetic oligonucleotide
  Target: AGXT; (+) strand; PAM type: NRG; PAM sequence: TAG
cttcctaaattcacaaggcc

SEQ ID NO: 13365 - DNA, 20 bp, Artificial Sequence
  Description of Artificial Sequence: Synthetic oligonucleotide
  Target: AGXT; (+) strand; PAM type: NRG; PAM sequence: TAG
cctaaattcacaaggcctag

SEQ ID NO: 13366 - DNA, 20 bp, Artificial Sequence
  Description of Artificial Sequence: Synthetic oligonucleotide
  Target: AGXT; (+) strand; PAM type: NRG; PAM sequence: TAG
aaggcctagtagcttctttg

SEQ ID NO: 13367 - DNA, 20 bp, Artificial Sequence
  Description of Artificial Sequence: Synthetic oligonucleotide
  Target: AGXT; (+) strand; PAM type: NRG; PAM sequence: AAG
tagattcctttaaattttct

SEQ ID NO: 13368 - DNA, 20 bp, Artificial Sequence
  Description of Artificial Sequence: Synthetic oligonucleotide
  Target: AGXT; (+) strand; PAM type: NRG; PAM sequence: TAG
attcctttaaattttctaag

SEQ ID NO: 13369 - DNA, 20 bp, Artificial Sequence
  Description of Artificial Sequence: Synthetic oligonucleotide
  Target: AGXT; (+) strand; PAM type: NRG; PAM sequence: GAG
tcaaactctctgtgactaat

SEQ ID NO: 13370 - DNA, 20 bp, Artificial Sequence
  Description of Artificial Sequence: Synthetic oligonucleotide
  Target: AGXT; (+) strand; PAM type: NRG; PAM sequence: GAG
aaactctctgtgactaatga

SEQ ID NO: 13371 - DNA, 20 bp, Artificial Sequence
  Description of Artificial Sequence: Synthetic oligonucleotide
  Target: AGXT; (+) strand; PAM type: NRG; PAM sequence: CGG
tttttcttgcttcattgcaa

SEQ ID NO: 13372 - DNA, 20 bp, Artificial Sequence
  Description of Artificial Sequence: Synthetic oligonucleotide
  Target: AGXT; (+) strand; PAM type: NRG; PAM sequence: TAG
cttgcttcattgcaacggtg

SEQ ID NO: 13373 - DNA, 20 bp, Artificial Sequence
  Description of Artificial Sequence: Synthetic oligonucleotide
  Target: AGXT; (+) strand; PAM type: NRG; PAM sequence: AGG
ttgcttcattgcaacggtgt

SEQ ID NO: 13374 - DNA, 20 bp, Artificial Sequence
  Description of Artificial Sequence: Synthetic oligonucleotide
  Target: AGXT; (+) strand; PAM type: NRG; PAM sequence: CAG
aacggtgtaggccacaaata

SEQ ID NO: 13375 - DNA, 20 bp, Artificial Sequence
  Description of Artificial Sequence: Synthetic oligonucleotide
  Target: AGXT; (+) strand; PAM type: NRG; PAM sequence: CAG
acaaatacagtgctgaatct

SEQ ID NO: 13376 - DNA, 20 bp, Artificial Sequence
  Description of Artificial Sequence: Synthetic oligonucleotide
  Target: AGXT; (+) strand; PAM type: NRG; PAM sequence: GAG
cagtgctgaatctcagtgat

SEQ ID NO: 13377 - DNA, 20 bp, Artificial Sequence
  Description of Artificial Sequence: Synthetic oligonucleotide
  Target: AGXT; (+) strand; PAM type: NRG; PAM sequence: TGG
gagtgtgcaccttctcgcct

SEQ ID NO: 13378 - DNA, 20 bp, Artificial Sequence
  Description of Artificial Sequence: Synthetic oligonucleotide
  Target: AGXT; (+) strand; PAM type: NRG; PAM sequence: GAG
gtgtgcaccttctcgccttg

SEQ ID NO: 13379 - DNA, 20 bp, Artificial Sequence
  Description of Artificial Sequence: Synthetic oligonucleotide
  Target: AGXT; (+) strand; PAM type: NRG; PAM sequence: CAG
tggagacgtgtttaatgtct

SEQ ID NO: 13380 - DNA, 20 bp, Artificial Sequence
  Description of Artificial Sequence: Synthetic oligonucleotide
  Target: AGXT; (+) strand; PAM type: NRG; PAM sequence: CAG
cgtgtttaatgtctcagcgt

SEQ ID NO: 13381 - DNA, 20 bp, Artificial Sequence
  Description of Artificial Sequence: Synthetic oligonucleotide
  Target: AGXT; (+) strand; PAM type: NRG; PAM sequence: AGG
gtgtttaatgtctcagcgtc

SEQ ID NO: 13382 - DNA, 20 bp, Artificial Sequence
  Description of Artificial Sequence: Synthetic oligonucleotide
  Target: AGXT; (+) strand; PAM type: NRG; PAM sequence: CGG
atgtctcagcgtcaggctga

SEQ ID NO: 13383 - DNA, 20 bp, Artificial Sequence
  Description of Artificial Sequence: Synthetic oligonucleotide
  Target: AGXT; (+) strand; PAM type: NRG; PAM sequence: CAG
tctcagcgtcaggctgacgg

SEQ ID NO: 13384 - DNA, 20 bp, Artificial Sequence
  Description of Artificial Sequence: Synthetic oligonucleotide
  Target: AGXT; (+) strand; PAM type: NRG; PAM sequence: CAG
cagcgtcaggctgacggcag

SEQ ID NO: 13385 - DNA, 20 bp, Artificial Sequence
  Description of Artificial Sequence: Synthetic oligonucleotide
  Target: AGXT; (+) strand; PAM type: NRG; PAM sequence: TGG
cgtcaggctgacggcagcag

SEQ ID NO: 13386 - DNA, 20 bp, Artificial Sequence
  Description of Artificial Sequence: Synthetic oligonucleotide
  Target: AGXT; (+) strand; PAM type: NRG; PAM sequence: GGG
gtcaggctgacggcagcagt

SEQ ID NO: 13387 - DNA, 20 bp, Artificial Sequence
  Description of Artificial Sequence: Synthetic oligonucleotide
  Target: AGXT; (+) strand; PAM type: NRG; PAM sequence: GGG
tcaggctgacggcagcagtg

SEQ ID NO: 13388 - DNA, 20 bp, Artificial Sequence
  Description of Artificial Sequence: Synthetic oligonucleotide
  Target: AGXT; (+) strand; PAM type: NRG; PAM sequence: CAG
cggcagcagtggggtttctg

SEQ ID NO: 13389 - DNA, 20 bp, Artificial Sequence
  Description of Artificial Sequence: Synthetic oligonucleotide
  Target: AGXT; (+) strand; PAM type: NRG; PAM sequence: CAG
ctgcagctgccctgctctca

SEQ ID NO: 13390 - DNA, 20 bp, Artificial Sequence
  Description of Artificial Sequence: Synthetic oligonucleotide
  Target: AGXT; (+) strand; PAM type: NRG; PAM sequence: AGG
tgcagctgccctgctctcac

SEQ ID NO: 13391 - DNA, 20 bp, Artificial Sequence
  Description of Artificial Sequence: Synthetic oligonucleotide
  Target: AGXT; (+) strand; PAM type: NRG; PAM sequence: CAG
agctgccctgctctcacagg

SEQ ID NO: 13392 - DNA, 20 bp, Artificial Sequence
  Description of Artificial Sequence: Synthetic oligonucleotide
  Target: AGXT; (+) strand; PAM type: NRG; PAM sequence: AGG
gctgccctgctctcacaggc

SEQ ID NO: 13393 - DNA, 20 bp, Artificial Sequence
  Description of Artificial Sequence: Synthetic oligonucleotide
  Target: AGXT; (+) strand; PAM type: NRG; PAM sequence: AAG
gccctgctctcacaggcagg

SEQ ID NO: 13394 - DNA, 20 bp, Artificial Sequence
  Description of Artificial Sequence: Synthetic oligonucleotide
  Target: AGXT; (+) strand; PAM type: NRG; PAM sequence: TAG
caggaagtccccacctgtcc

SEQ ID NO: 13395 - DNA, 20 bp, Artificial Sequence
  Description of Artificial Sequence: Synthetic oligonucleotide
  Target: AGXT; (+) strand; PAM type: NRG; PAM sequence: CAG
tccccacctgtcctagtttg

SEQ ID NO: 13396 - DNA, 20 bp, Artificial Sequence
  Description of Artificial Sequence: Synthetic oligonucleotide
  Target: AGXT; (+) strand; PAM type: NRG; PAM sequence: GAG
cccacctgtcctagtttgca

SEQ ID NO: 13397 - DNA, 20 bp, Artificial Sequence
  Description of Artificial Sequence: Synthetic oligonucleotide
  Target: AGXT; (+) strand; PAM type: NRG; PAM sequence: AGG
ccacctgtcctagtttgcag

SEQ ID NO: 13398 - DNA, 20 bp, Artificial Sequence
  Description of Artificial Sequence: Synthetic oligonucleotide
  Target: AGXT; (+) strand; PAM type: NRG; PAM sequence: GGG
cacctgtcctagtttgcaga

SEQ ID NO: 13399 - DNA, 20 bp, Artificial Sequence
  Description of Artificial Sequence: Synthetic oligonucleotide
  Target: AGXT; (+) strand; PAM type: NRG; PAM sequence: CAG
cagagggtatttatcactaa

SEQ ID NO: 13400 - DNA, 20 bp, Artificial Sequence
  Description of Artificial Sequence: Synthetic oligonucleotide
  Target: AGXT; (+) strand; PAM type: NRG; PAM sequence: TGG
tcaaataccttttctgccta

SEQ ID NO: 13401 - DNA, 20 bp, Artificial Sequence
  Description of Artificial Sequence: Synthetic oligonucleotide
  Target: AGXT; (+) strand; PAM type: NRG; PAM sequence: GAG
ataccttttctgcctatggt

SEQ ID NO: 13402 - DNA, 20 bp, Artificial Sequence
  Description of Artificial Sequence: Synthetic oligonucleotide
  Target: AGXT; (+) strand; PAM type: NRG; PAM sequence: AAG
cctatggtgagatgatcata

SEQ ID NO: 13403 - DNA, 20 bp, Artificial Sequence
  Description of Artificial Sequence: Synthetic oligonucleotide
  Target: AGXT; (+) strand; PAM type: NRG; PAM sequence: CGG
agttatgtttctatattcta

SEQ ID NO: 13404 - DNA, 20 bp, Artificial Sequence
  Description of Artificial Sequence: Synthetic oligonucleotide
  Target: AGXT; (+) strand; PAM type: NRG; PAM sequence: CAG
ttttctcgtaatatatttgt

SEQ ID NO: 13405 - DNA, 20 bp, Artificial Sequence
  Description of Artificial Sequence: Synthetic oligonucleotide
  Target: AGXT; (+) strand; PAM type: NRG; PAM sequence: AGG
tttctcgtaatatatttgtc

SEQ ID NO: 13406 - DNA, 20 bp, Artificial Sequence
  Description of Artificial Sequence: Synthetic oligonucleotide
  Target: AGXT; (+) strand; PAM type: NRG; PAM sequence: TAG
atatatttgtcaggttttga

SEQ ID NO: 13407 - DNA, 20 bp, Artificial Sequence
  Description of Artificial Sequence: Synthetic oligonucleotide
  Target: AGXT; (+) strand; PAM type: NRG; PAM sequence: AAG
atttgtcaggttttgatagc

SEQ ID NO: 13408 - DNA, 20 bp, Artificial Sequence
  Description of Artificial Sequence: Synthetic oligonucleotide
  Target: AGXT; (+) strand; PAM type: NRG; PAM sequence: AGG
tttgtcaggttttgatagca

SEQ ID NO: 13409 - DNA, 20 bp, Artificial Sequence
  Description of Artificial Sequence: Synthetic oligonucleotide
  Target: AGXT; (+) strand; PAM type: NRG; PAM sequence: TGG
ttttgatagcaaggttacat

SEQ ID NO: 13410 - DNA, 20 bp, Artificial Sequence
  Description of Artificial Sequence: Synthetic oligonucleotide
  Target: AGXT; (+) strand; PAM type: NRG; PAM sequence: AAG
aaggttacattggtcttgta

SEQ ID NO: 13411 - DNA, 20 bp, Artificial Sequence
  Description of Artificial Sequence: Synthetic oligonucleotide
  Target: AGXT; (+) strand; PAM type: NRG; PAM sequence: TGG
gttacattggtcttgtaaag

SEQ ID NO: 13412 - DNA, 20 bp, Artificial Sequence
  Description of Artificial Sequence: Synthetic oligonucleotide
  Target: AGXT; (+) strand; PAM type: NRG; PAM sequence: TGG
attggtcttgtaaagtggtt

SEQ ID NO: 13413 - DNA, 20 bp, Artificial Sequence
  Description of Artificial Sequence: Synthetic oligonucleotide
  Target: AGXT; (+) strand; PAM type: NRG; PAM sequence: CAG
gtcttgtaaagtggtttgga

SEQ ID NO: 13414 - DNA, 20 bp, Artificial Sequence
  Description of Artificial Sequence: Synthetic oligonucleotide
  Target: AGXT; (+) strand; PAM type: NRG; PAM sequence: TAG
atttatcaattaaatttgtc

SEQ ID NO: 13415 - DNA, 20 bp, Artificial Sequence
  Description of Artificial Sequence: Synthetic oligonucleotide
  Target: AGXT; (+) strand; PAM type: NRG; PAM sequence: TAG
tcaattaaatttgtctagaa

SEQ ID NO: 13416 - DNA, 20 bp, Artificial Sequence
  Description of Artificial Sequence: Synthetic oligonucleotide
  Target: AGXT; (+) strand; PAM type: NRG; PAM sequence: AGG
caattaaatttgtctagaat

SEQ ID NO: 13417 - DNA, 20 bp, Artificial Sequence
  Description of Artificial Sequence: Synthetic oligonucleotide
  Target: AGXT; (+) strand; PAM type: NRG; PAM sequence: GGG
aattaaatttgtctagaata

SEQ ID NO: 13418 - DNA, 20 bp, Artificial Sequence
  Description of Artificial Sequence: Synthetic oligonucleotide
  Target: AGXT; (+) strand; PAM type: NRG; PAM sequence: TGG
ttttttttttccttatattt

SEQ ID NO: 13419 - DNA, 20 bp, Artificial Sequence
  Description of Artificial Sequence: Synthetic oligonucleotide
  Target: AGXT; (+) strand; PAM type: NRG; PAM sequence: TAG
tttttttccttatattttgg

SEQ ID NO: 13420 - DNA, 20 bp, Artificial Sequence
  Description of Artificial Sequence: Synthetic oligonucleotide
  Target: AGXT; (+) strand; PAM type: NRG; PAM sequence: CAG
tatattttggtagaattgtc

SEQ ID NO: 13421 - DNA, 20 bp, Artificial Sequence
  Description of Artificial Sequence: Synthetic oligonucleotide
  Target: AGXT; (+) strand; PAM type: NRG; PAM sequence: AAG
tttggtagaattgtccagtg

SEQ ID NO: 13422 - DNA, 20 bp, Artificial Sequence
  Description of Artificial Sequence: Synthetic oligonucleotide
  Target: AGXT; (+) strand; PAM type: NRG; PAM sequence: TGG
aattgtccagtgaagcttta

SEQ ID NO: 13423 - DNA, 20 bp, Artificial Sequence
  Description of Artificial Sequence: Synthetic oligonucleotide
  Target: AGXT; (+) strand; PAM type: NRG; PAM sequence: GGG
attgtccagtgaagctttat

SEQ ID NO: 13424 - DNA, 20 bp, Artificial Sequence
  Description of Artificial Sequence: Synthetic oligonucleotide
  Target: AGXT; (+) strand; PAM type: NRG; PAM sequence: CAG
tccagtgaagctttatggga

SEQ ID NO: 13425 - DNA, 20 bp, Artificial Sequence
  Description of Artificial Sequence: Synthetic oligonucleotide
  Target: AGXT; (+) strand; PAM type: NRG; PAM sequence: AGG
ccagtgaagctttatgggac

SEQ ID NO: 13426 - DNA, 20 bp, Artificial Sequence
  Description of Artificial Sequence: Synthetic oligonucleotide
  Target: AGXT; (+) strand; PAM type: NRG; PAM sequence: GAG
agtgaagctttatgggacag

SEQ ID NO: 13427 - DNA, 20 bp, Artificial Sequence
  Description of Artificial Sequence: Synthetic oligonucleotide
  Target: AGXT; (+) strand; PAM type: NRG; PAM sequence: TGG
tgggacaggagctttcttta

SEQ ID NO: 13428 - DNA, 20 bp, Artificial Sequence
  Description of Artificial Sequence: Synthetic oligonucleotide
  Target: AGXT; (+) strand; PAM type: NRG; PAM sequence: GGG
gggacaggagctttctttat

SEQ ID NO: 13429 - DNA, 20 bp, Artificial Sequence
  Description of Artificial Sequence: Synthetic oligonucleotide
  Target: AGXT; (+) strand; PAM type: NRG; PAM sequence: AAG
acaggagctttctttatggg

SEQ ID NO: 13430 - DNA, 20 bp, Artificial Sequence
  Description of Artificial Sequence: Synthetic oligonucleotide
  Target: AGXT; (+) strand; PAM type: NRG; PAM sequence: AGG
caggagctttctttatggga

SEQ ID NO: 13431 - DNA, 20 bp, Artificial Sequence
  Description of Artificial Sequence: Synthetic oligonucleotide
  Target: AGXT; (+) strand; PAM type: NRG; PAM sequence: TAG
aatgacttctaatgttttca

SEQ ID NO: 13432 - DNA, 20 bp, Artificial Sequence
  Description of Artificial Sequence: Synthetic oligonucleotide
  Target: AGXT; (+) strand; PAM type: NRG; PAM sequence: TAG
ttctaatgttttcatagaca

SEQ ID NO: 13433 - DNA, 20 bp, Artificial Sequence
  Description of Artificial Sequence: Synthetic oligonucleotide
  Target: AGXT; (+) strand; PAM type: NRG; PAM sequence: GAG
ctaatgttttcatagacata

SEQ ID NO: 13434 - DNA, 20 bp, Artificial Sequence
  Description of Artificial Sequence: Synthetic oligonucleotide
  Target: AGXT; (+) strand; PAM type: NRG; PAM sequence: TAG
ttcatagacatagagttctt

SEQ ID NO: 13435 - DNA, 20 bp, Artificial Sequence
  Description of Artificial Sequence: Synthetic oligonucleotide
  Target: AGXT; (+) strand; PAM type: NRG; PAM sequence: TGG
ctctctctttgtgcccgttt

SEQ ID NO: 13436 - DNA, 20 bp, Artificial Sequence
  Description of Artificial Sequence: Synthetic oligonucleotide
  Target: AGXT; (+) strand; PAM type: NRG; PAM sequence: CAG
ttttggtaatttgtgttacc

SEQ ID NO: 13437 - DNA, 20 bp, Artificial Sequence
  Description of Artificial Sequence: Synthetic oligonucleotide
  Target: AGXT; (+) strand; PAM type: NRG; PAM sequence: GAG
ttggtaatttgtgttaccca

SEQ ID NO: 13438 - DNA, 20 bp, Artificial Sequence
  Description of Artificial Sequence: Synthetic oligonucleotide
  Target: AGXT; (+) strand; PAM type: NRG; PAM sequence: AAG
cccagagcatgcttgattcc

SEQ ID NO: 13439 - DNA, 20 bp, Artificial Sequence
  Description of Artificial Sequence: Synthetic oligonucleotide
  Target: AGXT; (+) strand; PAM type: NRG; PAM sequence: TGG
ttccaagttgttgaatgtgt

SEQ ID NO: 13440 - DNA, 20 bp, Artificial Sequence
  Description of Artificial Sequence: Synthetic oligonucleotide
  Target: AGXT; (+) strand; PAM type: NRG; PAM sequence: CGG
ttattatcctttaatgctta

SEQ ID NO: 13441 - DNA, 20 bp, Artificial Sequence
  Description of Artificial Sequence: Synthetic oligonucleotide
  Target: AGXT; (+) strand; PAM type: NRG; PAM sequence: GGG
tattatcctttaatgcttac

SEQ ID NO: 13442 - DNA, 20 bp, Artificial Sequence
  Description of Artificial Sequence: Synthetic oligonucleotide
  Target: AGXT; (+) strand; PAM type: NRG; PAM sequence: TGG
tgatttccctgtttcattcc

SEQ ID NO: 13443 - DNA, 20 bp, Artificial Sequence
  Description of Artificial Sequence: Synthetic oligonucleotide
  Target: AGXT; (+) strand; PAM type: NRG; PAM sequence: TGG
ccctgtttcattcctggtat

SEQ ID NO: 13444 - DNA, 20 bp, Artificial Sequence
  Description of Artificial Sequence: Synthetic oligonucleotide
  Target: AGXT; (+) strand; PAM type: NRG; PAM sequence: CAG
cttttttttctcccattgat

SEQ ID NO: 13445 - DNA, 20 bp, Artificial Sequence
  Description of Artificial Sequence: Synthetic oligonucleotide
  Target: AGXT; (+) strand; PAM type: NRG; PAM sequence: TAG
ctcccattgatcagtcttgc

SEQ ID NO: 13446 - DNA, 20 bp, Artificial Sequence
  Description of Artificial Sequence: Synthetic oligonucleotide
  Target: AGXT; (+) strand; PAM type: NRG; PAM sequence: AGG
tcccattgatcagtcttgct

SEQ ID NO: 13447 - DNA, 20 bp, Artificial Sequence
  Description of Artificial Sequence: Synthetic oligonucleotide
  Target: AGXT; (+) strand; PAM type: NRG; PAM sequence: GGG
cccattgatcagtcttgcta

SEQ ID NO: 13448 - DNA, 20 bp, Artificial Sequence
  Description of Artificial Sequence: Synthetic oligonucleotide
  Target: AGXT; (+) strand; PAM type: NRG; PAM sequence: GGG
ccattgatcagtcttgctag

SEQ ID NO: 13449 - DNA, 20 bp, Artificial Sequence
  Description of Artificial Sequence: Synthetic oligonucleotide
  Target: AGXT; (+) strand; PAM type: NRG; PAM sequence: GGG
cattgatcagtcttgctagg

SEQ ID NO: 13450 - DNA, 20 bp, Artificial Sequence
  Description of Artificial Sequence: Synthetic oligonucleotide
  Target: AGXT; (+) strand; PAM type: NRG; PAM sequence: TAG
tagggggttactgattttat

SEQ ID NO: 13451 - DNA, 20 bp, Artificial Sequence
  Description of Artificial Sequence: Synthetic oligonucleotide
  Target: AGXT; (+) strand; PAM type: NRG; PAM sequence: AAG
ttttattagtctctccaaaa

SEQ ID NO: 13452 - DNA, 20 bp, Artificial Sequence
  Description of Artificial Sequence: Synthetic oligonucleotide
  Target: AGXT; (+) strand; PAM type: NRG; PAM sequence: TGG
tccttttattttacttcctt

SEQ ID NO: 13453 - DNA, 20 bp, Artificial Sequence
  Description of Artificial Sequence: Synthetic oligonucleotide
  Target: AGXT; (+) strand; PAM type: NRG; PAM sequence: TAG
ttaatttgctcctctttttc

SEQ ID NO: 13454 - DNA, 20 bp, Artificial Sequence
  Description of Artificial Sequence: Synthetic oligonucleotide
  Target: AGXT; (+) strand; PAM type: NRG; PAM sequence: TGG
cctctttttctagcttccta

SEQ ID NO: 13455 - DNA, 20 bp, Artificial Sequence
  Description of Artificial Sequence: Synthetic oligonucleotide
  Target: AGXT; (+) strand; PAM type: NRG; PAM sequence: TAG
ctttttctagcttcctatgg

SEQ ID NO: 13456 - DNA, 20 bp, Artificial Sequence
  Description of Artificial Sequence: Synthetic oligonucleotide
  Target: AGXT; (+) strand; PAM type: NRG; PAM sequence: AAG
tttctagcttcctatggtag

SEQ ID NO: 13457 - DNA, 20 bp, Artificial Sequence
  Description of Artificial Sequence: Synthetic oligonucleotide
  Target: AGXT; (+) strand; PAM type: NRG; PAM sequence: TAG
ttaaacatttatttgttttc

SEQ ID NO: 13458 - DNA, 20 bp, Artificial Sequence
  Description of Artificial Sequence: Synthetic oligonucleotide
  Target: AGXT; (+) strand; PAM type: NRG; PAM sequence: GAG
atttatttgttttctagtat

SEQ ID NO: 13459 - DNA, 20 bp, Artificial Sequence
  Description of Artificial Sequence: Synthetic oligonucleotide
  Target: AGXT; (+) strand; PAM type: NRG; PAM sequence: AAG
ttttctagtatgagcattta

SEQ ID NO: 13460 - DNA, 20 bp, Artificial Sequence
  Description of Artificial Sequence: Synthetic oligonucleotide
  Target: AGXT; (+) strand; PAM type: NRG; PAM sequence: GAG
aaagctaaacatttccctct

SEQ ID NO: 13461 - DNA, 20 bp, Artificial Sequence
  Description of Artificial Sequence: Synthetic oligonucleotide
  Target: AGXT; (+) strand; PAM type: NRG; PAM sequence: TGG
atctcccaaattttaatcaa

SEQ ID NO: 13462 - DNA, 20 bp, Artificial Sequence
  Description of Artificial Sequence: Synthetic oligonucleotide
  Target: AGXT; (+) strand; PAM type: NRG; PAM sequence: TGG
attttaatcaatggtgtttt

SEQ ID NO: 13463 - DNA, 20 bp, Artificial Sequence
  Description of Artificial Sequence: Synthetic oligonucleotide
  Target: AGXT; (+) strand; PAM type: NRG; PAM sequence: CAG
atggtgtttttggaatcact

SEQ ID NO: 13464 - DNA, 20 bp, Artificial Sequence
  Description of Artificial Sequence: Synthetic oligonucleotide
  Target: AGXT; (+) strand; PAM type: NRG; PAM sequence: CAG
gtgatttattctttgaacca

SEQ ID NO: 13465 - DNA, 20 bp, Artificial Sequence
  Description of Artificial Sequence: Synthetic oligonucleotide
  Target: AGXT; (+) strand; PAM type: NRG; PAM sequence: TAG
tctttgaaccacagactatt

SEQ ID NO: 13466 - DNA, 20 bp, Artificial Sequence
  Description of Artificial Sequence: Synthetic oligonucleotide
  Target: AGXT; (+) strand; PAM type: NRG; PAM sequence: CAG
gacttatactgtgtaatgtt

SEQ ID NO: 13467 - DNA, 20 bp, Artificial Sequence
  Description of Artificial Sequence: Synthetic oligonucleotide
  Target: AGXT; (+) strand; PAM type: NRG; PAM sequence: TGG
ctgtgtaatgttcagatatt

SEQ ID NO: 13468 - DNA, 20 bp, Artificial Sequence
  Description of Artificial Sequence: Synthetic oligonucleotide
  Target: AGXT; (+) strand; PAM type: NRG; PAM sequence: TGG
tgtaatgttcagatatttgg

SEQ ID NO: 13469 - DNA, 20 bp, Artificial Sequence
  Description of Artificial Sequence: Synthetic oligonucleotide
  Target: AGXT; (+) strand; PAM type: NRG; PAM sequence: TGG
tttcaaatttatgtctgttg

SEQ ID NO: 13470 - DNA, 20 bp, Artificial Sequence
  Description of Artificial Sequence: Synthetic oligonucleotide
  Target: AGXT; (+) strand; PAM type: NRG; PAM sequence: CAG
aaatttatgtctgttgtggt

SEQ ID NO: 13471 - DNA, 20 bp, Artificial Sequence
  Description of Artificial Sequence: Synthetic oligonucleotide
  Target: AGXT; (+) strand; PAM type: NRG; PAM sequence: GAG
atttatgtctgttgtggtca

SEQ ID NO: 13472 - DNA, 20 bp, Artificial Sequence
  Description of Artificial Sequence: Synthetic oligonucleotide
  Target: AGXT; (+) strand; PAM type: NRG; PAM sequence: TGG
gtcagagctcatactgtata

SEQ ID NO: 13473 - DNA, 20 bp, Artificial Sequence
  Description of Artificial Sequence: Synthetic oligonucleotide
  Target: AGXT; (+) strand; PAM type: NRG; PAM sequence: CAG
ctcatactgtatatggactt

SEQ ID NO: 13474 - DNA, 20 bp, Artificial Sequence
  Description of Artificial Sequence: Synthetic oligonucleotide
  Target: AGXT; (+) strand; PAM type: NRG; PAM sequence: GAG
cagtattttgaacatgtact

SEQ ID NO: 13475 - DNA, 20 bp, Artificial Sequence
  Description of Artificial Sequence: Synthetic oligonucleotide
  Target: AGXT; (+) strand; PAM type: NRG; PAM sequence: GAG
gtattttgaacatgtactga

SEQ ID NO: 13476 - DNA, 20 bp, Artificial Sequence
  Description of Artificial Sequence: Synthetic oligonucleotide
  Target: AGXT; (+) strand; PAM type: NRG; PAM sequence: TAG
tgagagtctgttttataaac

SEQ ID NO: 13477 - DNA, 20 bp, Artificial Sequence
  Description of Artificial Sequence: Synthetic oligonucleotide
  Target: AGXT; (+) strand; PAM type: NRG; PAM sequence: CAG
gagtctgttttataaactag

SEQ ID NO: 13478 - DNA, 20 bp, Artificial Sequence
  Description of Artificial Sequence: Synthetic oligonucleotide
  Target: AGXT; (+) strand; PAM type: NRG; PAM sequence: CAG
tctgttttataaactagcag

SEQ ID NO: 13479 - DNA, 20 bp, Artificial Sequence
  Description of Artificial Sequence: Synthetic oligonucleotide
  Target: AGXT; (+) strand; PAM type: NRG; PAM sequence: CGG
ttataaactagcagcagtct

SEQ ID NO: 13480 - DNA, 20 bp, Artificial Sequence
  Description of Artificial Sequence: Synthetic oligonucleotide
  Target: AGXT; (+) strand; PAM type: NRG; PAM sequence: TGG
cagtctcggtgactatccca

SEQ ID NO: 13481 - DNA, 20 bp, Artificial Sequence
  Description of Artificial Sequence: Synthetic oligonucleotide
  Target: AGXT; (+) strand; PAM type: NRG; PAM sequence: GAG
ggtgactatcccatggacac

SEQ ID NO: 13482 - DNA, 20 bp, Artificial Sequence
  Description of Artificial Sequence: Synthetic oligonucleotide
  Target: AGXT; (+) strand; PAM type: NRG; PAM sequence: CAG
gaacgtgtcttcgtcattgt

SEQ ID NO: 13483 - DNA, 20 bp, Artificial Sequence
  Description of Artificial Sequence: Synthetic oligonucleotide
  Target: AGXT; (+) strand; PAM type: NRG; PAM sequence: AGG
aacgtgtcttcgtcattgtc

SEQ ID NO: 13484 - DNA, 20 bp, Artificial Sequence
  Description of Artificial Sequence: Synthetic oligonucleotide
  Target: AGXT; (+) strand; PAM type: NRG; PAM sequence: GAG
tcttcgtcattgtcaggtgt

SEQ ID NO: 13485 - DNA, 20 bp, Artificial Sequence
  Description of Artificial Sequence: Synthetic oligonucleotide
  Target: AGXT; (+) strand; PAM type: NRG; PAM sequence: CAG
ttgtcaggtgtgagcttcta

SEQ ID NO: 13486 - DNA, 20 bp, Artificial Sequence
  Description of Artificial Sequence: Synthetic oligonucleotide
  Target: AGXT; (+) strand; PAM type: NRG; PAM sequence: CAG
tgtgagcttctacagatcct

SEQ ID NO: 13487 - DNA, 20 bp, Artificial Sequence
  Description of Artificial Sequence: Synthetic oligonucleotide
  Target: AGXT; (+) strand; PAM type: NRG; PAM sequence: AGG
gtgagcttctacagatcctc

SEQ ID NO: 13488 - DNA, 20 bp, Artificial Sequence
  Description of Artificial Sequence: Synthetic oligonucleotide
  Target: AGXT; (+) strand; PAM type: NRG; PAM sequence: TGG
tacagatcctcaggtccgcc

SEQ ID NO: 13489 - DNA, 20 bp, Artificial Sequence
  Description of Artificial Sequence: Synthetic oligonucleotide
  Target: AGXT; (+) strand; PAM type: NRG; PAM sequence: CAG
cctcaggtccgcctggatga

SEQ ID NO: 13490 - DNA, 20 bp, Artificial Sequence
  Description of Artificial Sequence: Synthetic oligonucleotide
  Target: AGXT; (+) strand; PAM type: NRG; PAM sequence: AAG
cctggatgacagcattgttc

SEQ ID NO: 13491 - DNA, 20 bp, Artificial Sequence
  Description of Artificial Sequence: Synthetic oligonucleotide
  Target: AGXT; (+) strand; PAM type: NRG; PAM sequence: TGG
tcaagtcttctttgtatcac

SEQ ID NO: 13492 - DNA, 20 bp, Artificial Sequence
  Description of Artificial Sequence: Synthetic oligonucleotide
  Target: AGXT; (+) strand; PAM type: NRG; PAM sequence: GGG
caagtcttctttgtatcact

SEQ ID NO: 13493 - DNA, 20 bp, Artificial Sequence
  Description of Artificial Sequence: Synthetic oligonucleotide
  Target: AGXT; (+) strand; PAM type: NRG; PAM sequence: GGG
aagtcttctttgtatcactg

SEQ ID NO: 13494 - DNA, 20 bp, Artificial Sequence
  Description of Artificial Sequence: Synthetic oligonucleotide
  Target: AGXT; (+) strand; PAM type: NRG; PAM sequence: TGG
tgttgttgtttgttttgttt

SEQ ID NO: 13495 - DNA, 20 bp, Artificial Sequence
  Description of Artificial Sequence: Synthetic oligonucleotide
  Target: AGXT; (+) strand; PAM type: NRG; PAM sequence: AAG
ttttgcctgctttttctatg

SEQ ID NO: 13496 - DNA, 20 bp, Artificial Sequence
  Description of Artificial Sequence: Synthetic oligonucleotide
  Target: AGXT; (+) strand; PAM type: NRG; PAM sequence: GAG
tgctttttctatgaagtact

SEQ ID NO: 13497 - DNA, 20 bp, Artificial Sequence
  Description of Artificial Sequence: Synthetic oligonucleotide
  Target: AGXT; (+) strand; PAM type: NRG; PAM sequence: GAG
ctttttctatgaagtactga

SEQ ID NO: 13498 - DNA, 20 bp, Artificial Sequence
  Description of Artificial Sequence: Synthetic oligonucleotide
  Target: AGXT; (+) strand; PAM type: NRG; PAM sequence: TGG
tttctatgaagtactgagag

SEQ ID NO: 13499 - DNA, 20 bp, Artificial Sequence
  Description of Artificial Sequence: Synthetic oligonucleotide
  Target: AGXT; (+) strand; PAM type: NRG; PAM sequence: GGG
ttctatgaagtactgagagt

SEQ ID NO: 13500 - DNA, 20 bp, Artificial Sequence
  Description of Artificial Sequence: Synthetic oligonucleotide
  Target: AGXT; (+) strand; PAM type: NRG; PAM sequence: GGG
tctatgaagtactgagagtg

SEQ ID NO: 13501 - DNA, 20 bp, Artificial Sequence
  Description of Artificial Sequence: Synthetic oligonucleotide
  Target: AGXT; (+) strand; PAM type: NRG; PAM sequence: CAG
agtactgagagtggggtgtt

SEQ ID NO: 13502 - DNA, 20 bp, Artificial Sequence
  Description of Artificial Sequence: Synthetic oligonucleotide
  Target: AGXT; (+) strand; PAM type: NRG; PAM sequence: CAG
agtggggtgttcagttctcc

SEQ ID NO: 13503 - DNA, 20 bp, Artificial Sequence
  Description of Artificial Sequence: Synthetic oligonucleotide
  Target: AGXT; (+) strand; PAM type: NRG; PAM sequence: TGG
cagttctcccagcatgaatg

SEQ ID NO: 13504 - DNA, 20 bp, Artificial Sequence
  Description of Artificial Sequence: Synthetic oligonucleotide
  Target: AGXT; (+) strand; PAM type: NRG; PAM sequence: AAG
cattcatcttcatgattttg

SEQ ID NO: 13505 - DNA, 20 bp, Artificial Sequence
  Description of Artificial Sequence: Synthetic oligonucleotide
  Target: AGXT; (+) strand; PAM type: NRG; PAM sequence: AGG
attcatcttcatgattttga

SEQ ID NO: 13506 - DNA, 20 bp, Artificial Sequence
  Description of Artificial Sequence: Synthetic oligonucleotide
  Target: AGXT; (+) strand; PAM type: NRG; PAM sequence: TAG
tgattttgaaggtctgttgt

SEQ ID NO: 13507 - DNA, 20 bp, Artificial Sequence
  Description of Artificial Sequence: Synthetic oligonucleotide
  Target: AGXT; (+) strand; PAM type: NRG; PAM sequence: AGG
gattttgaaggtctgttgtt

SEQ ID NO: 13508 - DNA, 20 bp, Artificial Sequence
  Description of Artificial Sequence: Synthetic oligonucleotide
  Target: AGXT; (+) strand; PAM type: NRG; PAM sequence: TGG
gaaatatcgccccttacctc

SEQ ID NO: 13509 - DNA, 20 bp, Artificial Sequence
  Description of Artificial Sequence: Synthetic oligonucleotide
  Target: AGXT; (+) strand; PAM type: NRG; PAM sequence: TGG
gtttgtgtgttttctttcct

SEQ ID NO: 13510 - DNA, 20 bp, Artificial Sequence
  Description of Artificial Sequence: Synthetic oligonucleotide
  Target: AGXT; (+) strand; PAM type: NRG; PAM sequence: GGG
tttgtgtgttttctttcctt

SEQ ID NO: 13511 - DNA, 20 bp, Artificial Sequence
  Description of Artificial Sequence: Synthetic oligonucleotide
  Target: AGXT; (+) strand; PAM type: NRG; PAM sequence: AAG
ccacttgtctctccatacaa

SEQ ID NO: 13512 - DNA, 20 bp, Artificial Sequence
  Description of Artificial Sequence: Synthetic oligonucleotide
  Target: AGXT; (+) strand; PAM type: NRG; PAM sequence: GAG
acttgtctctccatacaaaa

SEQ ID NO: 13513 - DNA, 20 bp, Artificial Sequence
  Description of Artificial Sequence: Synthetic oligonucleotide
  Target: AGXT; (+) strand; PAM type: NRG; PAM sequence: GAG
ttcttttcttttcttttttt

SEQ ID NO: 13514 - DNA, 20 bp, Artificial Sequence
  Description of Artificial Sequence: Synthetic oligonucleotide
  Target: AGXT; (+) strand; PAM type: NRG; PAM sequence: CGG
tttcttttctttttttgaga

SEQ ID NO: 13515 - DNA, 20 bp, Artificial Sequence
  Description of Artificial Sequence: Synthetic oligonucleotide
  Target: AGXT; (+) strand; PAM type: NRG; PAM sequence: GAG
tcttttctttttttgagacg

SEQ ID NO: 13516 - DNA, 20 bp, Artificial Sequence
  Description of Artificial Sequence: Synthetic oligonucleotide
  Target: AGXT; (+) strand; PAM type: NRG; PAM sequence: CAG
ggagtttcgctcttgttgcc

SEQ ID NO: 13517 - DNA, 20 bp, Artificial Sequence
  Description of Artificial Sequence: Synthetic oligonucleotide
  Target: AGXT; (+) strand; PAM type: NRG; PAM sequence: AGG
gagtttcgctcttgttgccc

SEQ ID NO: 13518 - DNA, 20 bp, Artificial Sequence
  Description of Artificial Sequence: Synthetic oligonucleotide
  Target: AGXT; (+) strand; PAM type: NRG; PAM sequence: TGG
ttcgctcttgttgcccaggc

SEQ ID NO: 13519 - DNA, 20 bp, Artificial Sequence
  Description of Artificial Sequence: Synthetic oligonucleotide
  Target: AGXT; (+) strand; PAM type: NRG; PAM sequence: GAG
cgctcttgttgcccaggctg

SEQ ID NO: 13520 - DNA, 20 bp, Artificial Sequence
  Description of Artificial Sequence: Synthetic oligonucleotide
  Target: AGXT; (+) strand; PAM type: NRG; PAM sequence: TGG
ttgcccaggctggagtgcaa

SEQ ID NO: 13521 - DNA, 20 bp, Artificial Sequence
  Description of Artificial Sequence: Synthetic oligonucleotide
  Target: AGXT; (+) strand; PAM type: NRG; PAM sequence: TGG
cccaggctggagtgcaatgg

SEQ ID NO: 13522 - DNA, 20 bp, Artificial Sequence
  Description of Artificial Sequence: Synthetic oligonucleotide
  Target: AGXT; (+) strand; PAM type: NRG; PAM sequence: GGG
ccaggctggagtgcaatggt

SEQ ID NO: 13523 - DNA, 20 bp, Artificial Sequence
  Description of Artificial Sequence: Synthetic oligonucleotide
  Target: AGXT; (+) strand; PAM type: NRG; PAM sequence: CGG
ggagtgcaatggtgggatct

SEQ ID NO: 13524 - DNA, 20 bp, Artificial Sequence
  Description of Artificial Sequence: Synthetic oligonucleotide
  Target: AGXT; (+) strand; PAM type: NRG; PAM sequence: CAG
ttaccgcaacctccacctcc

SEQ ID NO: 13525 - DNA, 20 bp, Artificial Sequence
  Description of Artificial Sequence: Synthetic oligonucleotide
  Target: AGXT; (+) strand; PAM type: NRG; PAM sequence: AGG
taccgcaacctccacctccc

SEQ ID NO: 13526 - DNA, 20 bp, Artificial Sequence
  Description of Artificial Sequence: Synthetic oligonucleotide
  Target: AGXT; (+) strand; PAM type: NRG; PAM sequence: AAG
aacctccacctcccaggttc

SEQ ID NO: 13527 - DNA, 20 bp, Artificial Sequence
  Description of Artificial Sequence: Synthetic oligonucleotide
  Target: AGXT; (+) strand; PAM type: NRG; PAM sequence: CAG
ttcaagcaattctcctgcct

SEQ ID NO: 13528 - DNA, 20 bp, Artificial Sequence
  Description of Artificial Sequence: Synthetic oligonucleotide
  Target: AGXT; (+) strand; PAM type: NRG; PAM sequence: GAG
ttctcctgcctcagcctccc

SEQ ID NO: 13529 - DNA, 20 bp, Artificial Sequence
  Description of Artificial Sequence: Synthetic oligonucleotide
  Target: AGXT; (+) strand; PAM type: NRG; PAM sequence: TAG
tcctgcctcagcctcccgag

SEQ ID NO: 13530 - DNA, 20 bp, Artificial Sequence
  Description of Artificial Sequence: Synthetic oligonucleotide
  Target: AGXT; (+) strand; PAM type: NRG; PAM sequence: TGG
gcctcagcctcccgagtagc

SEQ ID NO: 13531 - DNA, 20 bp, Artificial Sequence
  Description of Artificial Sequence: Synthetic oligonucleotide
  Target: AGXT; (+) strand; PAM type: NRG; PAM sequence: GGG
cctcagcctcccgagtagct

SEQ ID NO: 13532 - DNA, 20 bp, Artificial Sequence
  Description of Artificial Sequence: Synthetic oligonucleotide
  Target: AGXT; (+) strand; PAM type: NRG; PAM sequence: CAG
ctcccgagtagctgggatta

SEQ ID NO: 13533 - DNA, 20 bp, Artificial Sequence
  Description of Artificial Sequence: Synthetic oligonucleotide
  Target: AGXT; (+) strand; PAM type: NRG; PAM sequence: AGG
tcccgagtagctgggattac

SEQ ID NO: 13534 - DNA, 20 bp, Artificial Sequence
  Description of Artificial Sequence: Synthetic oligonucleotide
  Target: AGXT; (+) strand; PAM type: NRG; PAM sequence: CGG
caggcacctgccaccatgcc

SEQ ID NO: 13535 - DNA, 20 bp, Artificial Sequence
  Description of Artificial Sequence: Synthetic oligonucleotide
  Target: AGXT; (+) strand; PAM type: NRG; PAM sequence: TAG
cggctaattttttgtatttt

SEQ ID NO: 13536 - DNA, 20 bp, Artificial Sequence
  Description of Artificial Sequence: Synthetic oligonucleotide
  Target: AGXT; (+) strand; PAM type: NRG; PAM sequence: TAG
ctaattttttgtatttttag

SEQ ID NO: 13537 - DNA, 20 bp, Artificial Sequence
  Description of Artificial Sequence: Synthetic oligonucleotide
  Target: AGXT; (+) strand; PAM type: NRG; PAM sequence: GAG
aattttttgtatttttagta

SEQ ID NO: 13538 - DNA, 20 bp, Artificial Sequence
  Description of Artificial Sequence: Synthetic oligonucleotide
  Target: AGXT; (+) strand; PAM type: NRG; PAM sequence: CGG
ttttgtatttttagtagaga

SEQ ID NO: 13539 - DNA, 20 bp, Artificial Sequence
  Description of Artificial Sequence: Synthetic oligonucleotide
  Target: AGXT; (+) strand; PAM type: NRG; PAM sequence: GGG
tttgtatttttagtagagac

SEQ ID NO: 13540 - DNA, 20 bp, Artificial Sequence
  Description of Artificial Sequence: Synthetic oligonucleotide
  Target: AGXT; (+) strand; PAM type: NRG; PAM sequence: GGG
ttgtatttttagtagagacg

SEQ ID NO: 13541 - DNA, 20 bp, Artificial Sequence
  Description of Artificial Sequence: Synthetic oligonucleotide
  Target: AGXT; (+) strand; PAM type: NRG; PAM sequence: TGG
gagacggggttttaccatgt

SEQ ID NO: 13542 - DNA, 20 bp, Artificial Sequence
  Description of Artificial Sequence: Synthetic oligonucleotide
  Target: AGXT; (+) strand; PAM type: NRG; PAM sequence: CAG
cggggttttaccatgttggc

SEQ ID NO: 13543 - DNA, 20 bp, Artificial Sequence
  Description of Artificial Sequence: Synthetic oligonucleotide
  Target: AGXT; (+) strand; PAM type: NRG; PAM sequence: AGG
ggggttttaccatgttggcc

SEQ ID NO: 13544 - DNA, 20 bp, Artificial Sequence
  Description of Artificial Sequence: Synthetic oligonucleotide
  Target: AGXT; (+) strand; PAM type: NRG; PAM sequence: TGG
ttttaccatgttggccaggc

SEQ ID NO: 13545 - DNA, 20 bp, Artificial Sequence
  Description of Artificial Sequence: Synthetic oligonucleotide
  Target: AGXT; (+) strand; PAM type: NRG; PAM sequence: CAG
tggtctcgaactcctgacct

SEQ ID NO: 13546 - DNA, 20 bp, Artificial Sequence
  Description of Artificial Sequence: Synthetic oligonucleotide
  Target: AGXT; (+) strand; PAM type: NRG; PAM sequence: AGG
ggtctcgaactcctgacctc

SEQ ID NO: 13547 - DNA, 20 bp, Artificial Sequence
  Description of Artificial Sequence: Synthetic oligonucleotide
  Target: AGXT; (+) strand; PAM type: NRG; PAM sequence: CGG
ctcaggtgatccacccaccc

SEQ ID NO: 13548 - DNA, 20 bp, Artificial Sequence
  Description of Artificial Sequence: Synthetic oligonucleotide
  Target: AGXT; (+) strand; PAM type: NRG; PAM sequence: AAG
ccacccaccccggcctccca

SEQ ID NO: 13549 - DNA, 20 bp, Artificial Sequence
  Description of Artificial Sequence: Synthetic oligonucleotide
  Target: AGXT; (+) strand; PAM type: NRG; PAM sequence: TGG
accccggcctcccaaagtgc

SEQ ID NO: 13550 - DNA, 20 bp, Artificial Sequence
  Description of Artificial Sequence: Synthetic oligonucleotide
  Target: AGXT; (+) strand; PAM type: NRG; PAM sequence: GGG
ccccggcctcccaaagtgct

SEQ ID NO: 13551 - DNA, 20 bp, Artificial Sequence
  Description of Artificial Sequence: Synthetic oligonucleotide
  Target: AGXT; (+) strand; PAM type: NRG; PAM sequence: CAG
ctcccaaagtgctgggatta

SEQ ID NO: 13552 - DNA, 20 bp, Artificial Sequence
  Description of Artificial Sequence: Synthetic oligonucleotide
  Target: AGXT; (+) strand; PAM type: NRG; PAM sequence: GAG
agtgctgggattacagatgt

SEQ ID NO: 13553 - DNA, 20 bp, Artificial Sequence
  Description of Artificial Sequence: Synthetic oligonucleotide
  Target: AGXT; (+) strand; PAM type: NRG; PAM sequence: TGG
cagatgtgagccaccgcgcc

SEQ ID NO: 13554 - DNA, 20 bp, Artificial Sequence
  Description of Artificial Sequence: Synthetic oligonucleotide
  Target: AGXT; (+) strand; PAM type: NRG; PAM sequence: CAG
gtgagccaccgcgcctggcc

SEQ ID NO: 13555 - DNA, 20 bp, Artificial Sequence
  Description of Artificial Sequence: Synthetic oligonucleotide
  Target: AGXT; (+) strand; PAM type: NRG; PAM sequence: CGG
ttcttgatactctgcccatg

SEQ ID NO: 13556 - DNA, 20 bp, Artificial Sequence
  Description of Artificial Sequence: Synthetic oligonucleotide
  Target: AGXT; (+) strand; PAM type: NRG; PAM sequence: GAG
cttgatactctgcccatgcg

SEQ ID NO: 13557 - DNA, 20 bp, Artificial Sequence
  Description of Artificial Sequence: Synthetic oligonucleotide
  Target: AGXT; (+) strand; PAM type: NRG; PAM sequence: AGG
ttgatactctgcccatgcgg

SEQ ID NO: 13558 - DNA, 20 bp, Artificial Sequence
  Description of Artificial Sequence: Synthetic oligonucleotide
  Target: AGXT; (+) strand; PAM type: NRG; PAM sequence: TAG
tttccctcaccactctcttc

SEQ ID NO: 13559 - DNA, 20 bp, Artificial Sequence
  Description of Artificial Sequence: Synthetic oligonucleotide
  Target: AGXT; (+) strand; PAM type: NRG; PAM sequence: AGG
ttccctcaccactctcttct

SEQ ID NO: 13560 - DNA, 20 bp, Artificial Sequence
  Description of Artificial Sequence: Synthetic oligonucleotide
  Target: AGXT; (+) strand; PAM type: NRG; PAM sequence: GAG
cactctcttctaggaaccct

SEQ ID NO: 13561 - DNA, 20 bp, Artificial Sequence
  Description of Artificial Sequence: Synthetic oligonucleotide
  Target: AGXT; (+) strand; PAM type: NRG; PAM sequence: TGG
ctcttctaggaaccctgagt

SEQ ID NO: 13562 - DNA, 20 bp, Artificial Sequence
  Description of Artificial Sequence: Synthetic oligonucleotide
  Target: AGXT; (+) strand; PAM type: NRG; PAM sequence: GGG
tcttctaggaaccctgagtt

SEQ ID NO: 13563 - DNA, 20 bp, Artificial Sequence
  Description of Artificial Sequence: Synthetic oligonucleotide
  Target: AGXT; (+) strand; PAM type: NRG; PAM sequence: AAG
ctaggaaccctgagttggga

SEQ ID NO: 13564 - DNA, 20 bp, Artificial Sequence
  Description of Artificial Sequence: Synthetic oligonucleotide
  Target: AGXT; (+) strand; PAM type: NRG; PAM sequence: TGG
tgagttgggaaagtccattt

SEQ ID NO: 13565 - DNA, 20 bp, Artificial Sequence
  Description of Artificial Sequence: Synthetic oligonucleotide
  Target: AGXT; (+) strand; PAM type: NRG; PAM sequence: AAG
tccattttggttcgcaccaa

SEQ ID NO: 13566 - DNA, 20 bp, Artificial Sequence
  Description of Artificial Sequence: Synthetic oligonucleotide
  Target: AGXT; (+) strand; PAM type: NRG; PAM sequence: AAG
ttggttcgcaccaaaagacc

SEQ ID NO: 13567 - DNA, 20 bp, Artificial Sequence
  Description of Artificial Sequence: Synthetic oligonucleotide
  Target: AGXT; (-) strand; PAM type: YTN; PAM sequence: TTA
gtttgtttatctgcataatt

SEQ ID NO: 13568 - DNA, 20 bp, Artificial Sequence
  Description of Artificial Sequence: Synthetic oligonucleotide
  Target: AGXT; (-) strand; PAM type: YTN; PAM sequence: TTT
agtttgtttatctgcataat

SEQ ID NO: 13569 - DNA, 20 bp, Artificial Sequence
  Description of Artificial Sequence: Synthetic oligonucleotide
  Target: AGXT; (-) strand; PAM type: YTN; PAM sequence: TTG
atttagtttgtttatctgca

SEQ ID NO: 13570 - DNA, 20 bp, Artificial Sequence
  Description of Artificial Sequence: Synthetic oligonucleotide
  Target: AGXT; (-) strand; PAM type: YTN; PAM sequence: TTG
ggtgaggaaagagggtggcc

SEQ ID NO: 13571 - DNA, 20 bp, Artificial Sequence
  Description of Artificial Sequence: Synthetic oligonucleotide
  Target: AGXT; (-) strand; PAM type: YTN; PAM sequence: TTG
gtgggattgggtgaggaaag

SEQ ID NO: 13572 - DNA, 20 bp, Artificial Sequence
  Description of Artificial Sequence: Synthetic oligonucleotide
  Target: AGXT; (-) strand; PAM type: YTN; PAM sequence: TTT
ggtgggattgggtgaggaaa

SEQ ID NO: 13573 - DNA, 20 bp, Artificial Sequence
  Description of Artificial Sequence: Synthetic oligonucleotide
  Target: AGXT; (-) strand; PAM type: YTN; PAM sequence: TTT
tggtgggattgggtgaggaa

SEQ ID NO: 13574 - DNA, 20 bp, Artificial Sequence
  Description of Artificial Sequence: Synthetic oligonucleotide
  Target: AGXT; (-) strand; PAM type: YTN; PAM sequence: CTG
gggttttggtgggattgggt

SEQ ID NO: 13575 - DNA, 20 bp, Artificial Sequence
  Description of Artificial Sequence: Synthetic oligonucleotide
  Target: AGXT; (-) strand; PAM type: YTN; PAM sequence: TTG
tggggtgtgctggggttttg

SEQ ID NO: 13576 - DNA, 20 bp, Artificial Sequence
  Description of Artificial Sequence: Synthetic oligonucleotide
  Target: AGXT; (-) strand; PAM type: YTN; PAM sequence: TTT
gtggggtgtgctggggtttt

SEQ ID NO: 13577 - DNA, 20 bp, Artificial Sequence
  Description of Artificial Sequence: Synthetic oligonucleotide
  Target: AGXT; (-) strand; PAM type: YTN; PAM sequence: TTT
tgtggggtgtgctggggttt

SEQ ID NO: 13578 - DNA, 20 bp, Artificial Sequence
  Description of Artificial Sequence: Synthetic oligonucleotide
  Target: AGXT; (-) strand; PAM type: YTN; PAM sequence: TTG
taaattttgtggggtgtgct

SEQ ID NO: 13579 - DNA, 20 bp, Artificial Sequence
  Description of Artificial Sequence: Synthetic oligonucleotide
  Target: AGXT; (-) strand; PAM type: YTN; PAM sequence: TTT
gtaaattttgtggggtgtgc

SEQ ID NO: 13580 - DNA, 20 bp, Artificial Sequence
  Description of Artificial Sequence: Synthetic oligonucleotide
  Target: AGXT; (-) strand; PAM type: YTN; PAM sequence: TTT
tgtaaattttgtggggtgtg

SEQ ID NO: 13581 - DNA, 20 bp, Artificial Sequence
  Description of Artificial Sequence: Synthetic oligonucleotide
  Target: AGXT; (-) strand; PAM type: YTN; PAM sequence: CTT
ttgtaaattttgtggggtgt

SEQ ID NO: 13582 - DNA, 20 bp, Artificial Sequence
  Description of Artificial Sequence: Synthetic oligonucleotide
  Target: AGXT; (-) strand; PAM type: YTN; PAM sequence: TTA
gtgccttttgtaaattttgt

SEQ ID NO: 13583 - DNA, 20 bp, Artificial Sequence
  Description of Artificial Sequence: Synthetic oligonucleotide
  Target: AGXT; (-) strand; PAM type: YTN; PAM sequence: TTT
agtgccttttgtaaattttg

SEQ ID NO: 13584 - DNA, 20 bp, Artificial Sequence
  Description of Artificial Sequence: Synthetic oligonucleotide
  Target: AGXT; (-) strand; PAM type: YTN; PAM sequence: TTT
tagtgccttttgtaaatttt

SEQ ID NO: 13585 - DNA, 20 bp, Artificial Sequence
  Description of Artificial Sequence: Synthetic oligonucleotide
  Target: AGXT; (-) strand; PAM type: YTN; PAM sequence: CTG
ttttagtgccttttgtaaat

SEQ ID NO: 13586 - DNA, 20 bp, Artificial Sequence
  Description of Artificial Sequence: Synthetic oligonucleotide
  Target: AGXT; (-) strand; PAM type: YTN; PAM sequence: TTC
aggaatgaatgtgaaaccct

SEQ ID NO: 13587 - DNA, 20 bp, Artificial Sequence
  Description of Artificial Sequence: Synthetic oligonucleotide
  Target: AGXT; (-) strand; PAM type: YTN; PAM sequence: CTT
caggaatgaatgtgaaaccc

SEQ ID NO: 13588 - DNA, 20 bp, Artificial Sequence
  Description of Artificial Sequence: Synthetic oligonucleotide
  Target: AGXT; (-) strand; PAM type: YTN; PAM sequence: TTG
aagccatccttcaggaatga

SEQ ID NO: 13589 - DNA, 20 bp, Artificial Sequence
  Description of Artificial Sequence: Synthetic oligonucleotide
  Target: AGXT; (-) strand; PAM type: YTN; PAM sequence: TTT
gaagccatccttcaggaatg

SEQ ID NO: 13590 - DNA, 20 bp, Artificial Sequence
  Description of Artificial Sequence: Synthetic oligonucleotide
  Target: AGXT; (-) strand; PAM type: YTN; PAM sequence: TTT
tgaagccatccttcaggaat

SEQ ID NO: 13591 - DNA, 20 bp, Artificial Sequence
  Description of Artificial Sequence: Synthetic oligonucleotide
  Target: AGXT; (-) strand; PAM type: YTN; PAM sequence: TTC
agagttttgaagccatcctt

SEQ ID NO: 13592 - DNA, 20 bp, Artificial Sequence
  Description of Artificial Sequence: Synthetic oligonucleotide
  Target: AGXT; (-) strand; PAM type: YTN; PAM sequence: TTT
cagagttttgaagccatcct

SEQ ID NO: 13593 - DNA, 20 bp, Artificial Sequence
  Description of Artificial Sequence: Synthetic oligonucleotide
  Target: AGXT; (-) strand; PAM type: YTN; PAM sequence: TTT
tcagagttttgaagccatcc

SEQ ID NO: 13594 - DNA, 20 bp, Artificial Sequence
  Description of Artificial Sequence: Synthetic oligonucleotide
  Target: AGXT; (-) strand; PAM type: YTN; PAM sequence: TTA
ttttcagagttttgaagcca

SEQ ID NO: 13595 - DNA, 20 bp, Artificial Sequence
  Description of Artificial Sequence: Synthetic oligonucleotide
  Target: AGXT; (-) strand; PAM type: YTN; PAM sequence: TTT
attttcagagttttgaagcc

SEQ ID NO: 13596 - DNA, 20 bp, Artificial Sequence
  Description of Artificial Sequence: Synthetic oligonucleotide
  Target: AGXT; (-) strand; PAM type: YTN; PAM sequence: CTC
agggaggagaagtttatttt

SEQ ID NO: 13597 - DNA, 20 bp, Artificial Sequence
  Description of Artificial Sequence: Synthetic oligonucleotide
  Target: AGXT; (-) strand; PAM type: YTN; PAM sequence: TTG
tggaacctcagggaggagaa

SEQ ID NO: 13598 - DNA, 20 bp, Artificial Sequence
  Description of Artificial Sequence: Synthetic oligonucleotide
  Target: AGXT; (-) strand; PAM type: YTN; PAM sequence: TTC
cattgtggaacctcagggag

SEQ ID NO: 13599 - DNA, 20 bp, Artificial Sequence
  Description of Artificial Sequence: Synthetic oligonucleotide
  Target: AGXT; (-) strand; PAM type: YTN; PAM sequence: TTT
ccattgtggaacctcaggga

SEQ ID NO: 13600 - DNA, 20 bp, Artificial Sequence
  Description of Artificial Sequence: Synthetic oligonucleotide
  Target: AGXT; (-) strand; PAM type: YTN; PAM sequence: TTT
tccattgtggaacctcaggg

SEQ ID NO: 13601 - DNA, 20 bp, Artificial Sequence
  Description of Artificial Sequence: Synthetic oligonucleotide
  Target: AGXT; (-) strand; PAM type: YTN; PAM sequence: TTA
gaggattttccattgtggaa

SEQ ID NO: 13602 - DNA, 20 bp, Artificial Sequence
  Description of Artificial Sequence: Synthetic oligonucleotide
  Target: AGXT; (-) strand; PAM type: YTN; PAM sequence: TTT
agaggattttccattgtgga

SEQ ID NO: 13603 - DNA, 20 bp, Artificial Sequence
  Description of Artificial Sequence: Synthetic oligonucleotide
  Target: AGXT; (-) strand; PAM type: YTN; PAM sequence: TTT
tagaggattttccattgtgg

SEQ ID NO: 13604 - DNA, 20 bp, Artificial Sequence
  Description of Artificial Sequence: Synthetic oligonucleotide
  Target: AGXT; (-) strand; PAM type: YTN; PAM sequence: TTG
atggagattttagaggattt

SEQ ID NO: 13605 - DNA, 20 bp, Artificial Sequence
  Description of Artificial Sequence: Synthetic oligonucleotide
  Target: AGXT; (-) strand; PAM type: YTN; PAM sequence: CTT
gatggagattttagaggatt

SEQ ID NO: 13606 - DNA, 20 bp, Artificial Sequence
  Description of Artificial Sequence: Synthetic oligonucleotide
  Target: AGXT; (-) strand; PAM type: YTN; PAM sequence: TTA
gcttgatggagattttagag

SEQ ID NO: 13607 - DNA, 20 bp, Artificial Sequence
  Description of Artificial Sequence: Synthetic oligonucleotide
  Target: AGXT; (-) strand; PAM type: YTN; PAM sequence: TTC
cacccccaggtggttagctt

SEQ ID NO: 13608 - DNA, 20 bp, Artificial Sequence
  Description of Artificial Sequence: Synthetic oligonucleotide
  Target: AGXT; (-) strand; PAM type: YTN; PAM sequence: TTT
ccacccccaggtggttagct

SEQ ID NO: 13609 - DNA, 20 bp, Artificial Sequence
  Description of Artificial Sequence: Synthetic oligonucleotide
  Target: AGXT; (-) strand; PAM type: YTN; PAM sequence: TTG
taaagtttccacccccaggt

SEQ ID NO: 13610 - DNA, 20 bp, Artificial Sequence
  Description of Artificial Sequence: Synthetic oligonucleotide
  Target: AGXT; (-) strand; PAM type: YTN; PAM sequence: CTT
gtaaagtttccacccccagg

SEQ ID NO: 13611 - DNA, 20 bp, Artificial Sequence
  Description of Artificial Sequence: Synthetic oligonucleotide
  Target: AGXT; (-) strand; PAM type: YTN; PAM sequence: TTA
aggcttgtaaagtttccacc

SEQ ID NO: 13612 - DNA, 20 bp, Artificial Sequence
  Description of Artificial Sequence: Synthetic oligonucleotide
  Target: AGXT; (-) strand; PAM type: YTN; PAM sequence: CTT
aaggcttgtaaagtttccac

SEQ ID NO: 13613 - DNA, 20 bp, Artificial Sequence
  Description of Artificial Sequence: Synthetic oligonucleotide
  Target: AGXT; (-) strand; PAM type: YTN; PAM sequence: CTC
ttaaggcttgtaaagtttcc

SEQ ID NO: 13614 - DNA, 20 bp, Artificial Sequence
  Description of Artificial Sequence: Synthetic oligonucleotide
  Target: AGXT; (-) strand; PAM type: YTN; PAM sequence: TTG
aaaaagaggatctcttaagg

SEQ ID NO: 13615 - DNA, 20 bp, Artificial Sequence
  Description of Artificial Sequence: Synthetic oligonucleotide
  Target: AGXT; (-) strand; PAM type: YTN; PAM sequence: CTT
gaaaaagaggatctcttaag

SEQ ID NO: 13616 - DNA, 20 bp, Artificial Sequence
  Description of Artificial Sequence: Synthetic oligonucleotide
  Target: AGXT; (-) strand; PAM type: YTN; PAM sequence: TTA
ggcccttgaaaaagaggatc

SEQ ID NO: 13617 - DNA, 20 bp, Artificial Sequence
  Description of Artificial Sequence: Synthetic oligonucleotide
  Target: AGXT; (-) strand; PAM type: YTN; PAM sequence: CTA
ggttaggcccttgaaaaaga

SEQ ID NO: 13618 - DNA, 20 bp, Artificial Sequence
  Description of Artificial Sequence: Synthetic oligonucleotide
  Target: AGXT; (-) strand; PAM type: YTN; PAM sequence: CTA
ggctaggttaggcccttgaa

SEQ ID NO: 13619 - DNA, 20 bp, Artificial Sequence
  Description of Artificial Sequence: Synthetic oligonucleotide
  Target: AGXT; (-) strand; PAM type: YTN; PAM sequence: TTG
gggctaggctaggttaggcc

SEQ ID NO: 13620 - DNA, 20 bp, Artificial Sequence
  Description of Artificial Sequence: Synthetic oligonucleotide
  Target: AGXT; (-) strand; PAM type: YTN; PAM sequence: TTG
ggaaatgtcccatagagttg

SEQ ID NO: 13621 - DNA, 20 bp, Artificial Sequence
  Description of Artificial Sequence: Synthetic oligonucleotide
  Target: AGXT; (-) strand; PAM type: YTN; PAM sequence: TTG
ggcaggattgggaaatgtcc

SEQ ID NO: 13622 - DNA, 20 bp, Artificial Sequence
  Description of Artificial Sequence: Synthetic oligonucleotide
  Target: AGXT; (-) strand; PAM type: YTN; PAM sequence: TTG
acagcaaattgggcaggatt

SEQ ID NO: 13623 - DNA, 20 bp, Artificial Sequence
  Description of Artificial Sequence: Synthetic oligonucleotide
  Target: AGXT; (-) strand; PAM type: YTN; PAM sequence: TTG
attgacagcaaattgggcag

SEQ ID NO: 13624 - DNA, 20 bp, Artificial Sequence
  Description of Artificial Sequence: Synthetic oligonucleotide
  Target: AGXT; (-) strand; PAM type: YTN; PAM sequence: TTT
gattgacagcaaattgggca

SEQ ID NO: 13625 - DNA, 20 bp, Artificial Sequence
  Description of Artificial Sequence: Synthetic oligonucleotide
  Target: AGXT; (-) strand; PAM type: YTN; PAM sequence: CTC
aggatttgattgacagcaaa

SEQ ID NO: 13626 - DNA, 20 bp, Artificial Sequence
  Description of Artificial Sequence: Synthetic oligonucleotide
  Target: AGXT; (-) strand; PAM type: YTN; PAM sequence: TTG
caccctcaggatttgattga

SEQ ID NO: 13627 - DNA, 20 bp, Artificial Sequence
  Description of Artificial Sequence: Synthetic oligonucleotide
  Target: AGXT; (-) strand; PAM type: YTN; PAM sequence: TTC
attgcaccctcaggatttga

SEQ ID NO: 13628 - DNA, 20 bp, Artificial Sequence
  Description of Artificial Sequence: Synthetic oligonucleotide
  Target: AGXT; (-) strand; PAM type: YTN; PAM sequence: TTG
gaggagggcagggggttcat

SEQ ID NO: 13629 - DNA, 20 bp, Artificial Sequence
  Description of Artificial Sequence: Synthetic oligonucleotide
  Target: AGXT; (-) strand; PAM type: YTN; PAM sequence: TTG
aataggttggaggagggcag

SEQ ID NO: 13630 - DNA, 20 bp, Artificial Sequence
  Description of Artificial Sequence: Synthetic oligonucleotide
  Target: AGXT; (-) strand; PAM type: YTN; PAM sequence: CTA
cgttgaataggttggaggag

SEQ ID NO: 13631 - DNA, 20 bp, Artificial Sequence
  Description of Artificial Sequence: Synthetic oligonucleotide
  Target: AGXT; (-) strand; PAM type: YTN; PAM sequence: CTC
tacgttgaataggttggagg

SEQ ID NO: 13632 - DNA, 20 bp, Artificial Sequence
  Description of Artificial Sequence: Synthetic oligonucleotide
  Target: AGXT; (-) strand; PAM type: YTN; PAM sequence: CTG
ggacaggccctctacgttga

SEQ ID NO: 13633 - DNA, 20 bp, Artificial Sequence
  Description of Artificial Sequence: Synthetic oligonucleotide
  Target: AGXT; (-) strand; PAM type: YTN; PAM sequence: TTG
ccagtacgcccctgggacag

SEQ ID NO: 13634 - DNA, 20 bp, Artificial Sequence
  Description of Artificial Sequence: Synthetic oligonucleotide
  Target: AGXT; (-) strand; PAM type: YTN; PAM sequence: CTT
gccagtacgcccctgggaca

SEQ ID NO: 13635 - DNA, 20 bp, Artificial Sequence
  Description of Artificial Sequence: Synthetic oligonucleotide
  Target: AGXT; (-) strand; PAM type: YTN; PAM sequence: TTA
tgagagggcatgtgggcaga

SEQ ID NO: 13636 - DNA, 20 bp, Artificial Sequence
  Description of Artificial Sequence: Synthetic oligonucleotide
  Target: AGXT; (-) strand; PAM type: YTN; PAM sequence: CTT
atgagagggcatgtgggcag

SEQ ID NO: 13637 - DNA, 20 bp, Artificial Sequence
  Description of Artificial Sequence: Synthetic oligonucleotide
  Target: AGXT; (-) strand; PAM type: YTN; PAM sequence: CTG
aatcccttatgagagggcat

SEQ ID NO: 13638 - DNA, 20 bp, Artificial Sequence
  Description of Artificial Sequence: Synthetic oligonucleotide
  Target: AGXT; (-) strand; PAM type: YTN; PAM sequence: CTA
aaaggtatctgaatccctta

SEQ ID NO: 13639 - DNA, 20 bp, Artificial Sequence
  Description of Artificial Sequence: Synthetic oligonucleotide
  Target: AGXT; (-) strand; PAM type: YTN; PAM sequence: CTA
taaagactaaaaggtatctg

SEQ ID NO: 13640 - DNA, 20 bp, Artificial Sequence
  Description of Artificial Sequence: Synthetic oligonucleotide
  Target: AGXT; (-) strand; PAM type: YTN; PAM sequence: TTG
tgaaagtgtctataaagact

SEQ ID NO: 13641 - DNA, 20 bp, Artificial Sequence
  Description of Artificial Sequence: Synthetic oligonucleotide
  Target: AGXT; (-) strand; PAM type: YTN; PAM sequence: CTT
gtgaaagtgtctataaagac

SEQ ID NO: 13642 - DNA, 20 bp, Artificial Sequence
  Description of Artificial Sequence: Synthetic oligonucleotide
  Target: AGXT; (-) strand; PAM type: YTN; PAM sequence: TTA
gtccagcttgtgaaagtgtc

SEQ ID NO: 13643 - DNA, 20 bp, Artificial Sequence
  Description of Artificial Sequence: Synthetic oligonucleotide
  Target: AGXT; (-) strand; PAM type: YTN; PAM sequence: TTT
agtccagcttgtgaaagtgt

SEQ ID NO: 13644 - DNA, 20 bp, Artificial Sequence
  Description of Artificial Sequence: Synthetic oligonucleotide
  Target: AGXT; (-) strand; PAM type: YTN; PAM sequence: CTT
tagtccagcttgtgaaagtg

SEQ ID NO: 13645 - DNA, 20 bp, Artificial Sequence
  Description of Artificial Sequence: Synthetic oligonucleotide
  Target: AGXT; (-) strand; PAM type: YTN; PAM sequence: TTC
gagtgggaaggctttagtcc

SEQ ID NO: 13646 - DNA, 20 bp, Artificial Sequence
  Description of Artificial Sequence: Synthetic oligonucleotide
  Target: AGXT; (-) strand; PAM type: YTN; PAM sequence: CTG
ttcgagtgggaaggctttag

SEQ ID NO: 13647 - DNA, 20 bp, Artificial Sequence
  Description of Artificial Sequence: Synthetic oligonucleotide
  Target: AGXT; (-) strand; PAM type: YTN; PAM sequence: TTC
tgttcgagtgggaaggcttt

SEQ ID NO: 13648 - DNA, 20 bp, Artificial Sequence
  Description of Artificial Sequence: Synthetic oligonucleotide
  Target: AGXT; (-) strand; PAM type: YTN; PAM sequence: TTT
ctgttcgagtgggaaggctt

SEQ ID NO: 13649 - DNA, 20 bp, Artificial Sequence
  Description of Artificial Sequence: Synthetic oligonucleotide
  Target: AGXT; (-) strand; PAM type: YTN; PAM sequence: CTT
tctgttcgagtgggaaggct

SEQ ID NO: 13650 - DNA, 20 bp, Artificial Sequence
  Description of Artificial Sequence: Synthetic oligonucleotide
  Target: AGXT; (-) strand; PAM type: YTN; PAM sequence: CTC
tttctgttcgagtgggaagg

SEQ ID NO: 13651 - DNA, 20 bp, Artificial Sequence
  Description of Artificial Sequence: Synthetic oligonucleotide
  Target: AGXT; (-) strand; PAM type: YTN; PAM sequence: CTG
atgctctttctgttcgagtg

SEQ ID NO: 13652 - DNA, 20 bp, Artificial Sequence
  Description of Artificial Sequence: Synthetic oligonucleotide
  Target: AGXT; (-) strand; PAM type: YTN; PAM sequence: TTC
tgatgctctttctgttcgag

SEQ ID NO: 13653 - DNA, 20 bp, Artificial Sequence
  Description of Artificial Sequence: Synthetic oligonucleotide
  Target: AGXT; (-) strand; PAM type: YTN; PAM sequence: CTT
ctgatgctctttctgttcga

SEQ ID NO: 13654 - DNA, 20 bp, Artificial Sequence
  Description of Artificial Sequence: Synthetic oligonucleotide
  Target: AGXT; (-) strand; PAM type: YTN; PAM sequence: TTA
cttctgatgctctttctgtt

SEQ ID NO: 13655 - DNA, 20 bp, Artificial Sequence
  Description of Artificial Sequence: Synthetic oligonucleotide
  Target: AGXT; (-) strand; PAM type: YTN; PAM sequence: CTA
aaagagccgtagttacttct

SEQ ID NO: 13656 - DNA, 20 bp, Artificial Sequence
  Description of Artificial Sequence: Synthetic oligonucleotide
  Target: AGXT; (-) strand; PAM type: YTN; PAM sequence: TTC
taaaagagccgtagttactt

SEQ ID NO: 13657 - DNA, 20 bp, Artificial Sequence
  Description of Artificial Sequence: Synthetic oligonucleotide
  Target: AGXT; (-) strand; PAM type: YTN; PAM sequence: TTG
agggaccccaaatcgaggaa

SEQ ID NO: 13658 - DNA, 20 bp, Artificial Sequence
  Description of Artificial Sequence: Synthetic oligonucleotide
  Target: AGXT; (-) strand; PAM type: YTN; PAM sequence: TTG
gagggattgagggaccccaa

SEQ ID NO: 13659 - DNA, 20 bp, Artificial Sequence
  Description of Artificial Sequence: Synthetic oligonucleotide
  Target: AGXT; (-) strand; PAM type: YTN; PAM sequence: CTG
attggagggattgagggacc

SEQ ID NO: 13660 - DNA, 20 bp, Artificial Sequence
  Description of Artificial Sequence: Synthetic oligonucleotide
  Target: AGXT; (-) strand; PAM type: YTN; PAM sequence: TTG
tctgattggagggattgagg

SEQ ID NO: 13661 - DNA, 20 bp, Artificial Sequence
  Description of Artificial Sequence: Synthetic oligonucleotide
  Target: AGXT; (-) strand; PAM type: YTN; PAM sequence: CTG
gagtaatagaagaaataaag

SEQ ID NO: 13662 - DNA, 20 bp, Artificial Sequence
  Description of Artificial Sequence: Synthetic oligonucleotide
  Target: AGXT; (-) strand; PAM type: YTN; PAM sequence: TTC
ctggagtaatagaagaaata

SEQ ID NO: 13663 - DNA, 20 bp, Artificial Sequence
  Description of Artificial Sequence: Synthetic oligonucleotide
  Target: AGXT; (-) strand; PAM type: YTN; PAM sequence: CTG
attcctggagtaatagaaga

SEQ ID NO: 13664 - DNA, 20 bp, Artificial Sequence
  Description of Artificial Sequence: Synthetic oligonucleotide
  Target: AGXT; (-) strand; PAM type: YTN; PAM sequence: CTC
actgattcctggagtaatag

SEQ ID NO: 13665 - DNA, 20 bp, Artificial Sequence
  Description of Artificial Sequence: Synthetic oligonucleotide
  Target: AGXT; (-) strand; PAM type: YTN; PAM sequence: TTG
gagggcctcactgattcctg

SEQ ID NO: 13666 - DNA, 20 bp, Artificial Sequence
  Description of Artificial Sequence: Synthetic oligonucleotide
  Target: AGXT; (-) strand; PAM type: YTN; PAM sequence: TTT
ggagggcctcactgattcct

SEQ ID NO: 13667 - DNA, 20 bp, Artificial Sequence
  Description of Artificial Sequence: Synthetic oligonucleotide
  Target: AGXT; (-) strand; PAM type: YTN; PAM sequence: TTA
tttggagggcctcactgatt

SEQ ID NO: 13668 - DNA, 20 bp, Artificial Sequence
  Description of Artificial Sequence: Synthetic oligonucleotide
  Target: AGXT; (-) strand; PAM type: YTN; PAM sequence: TTT
atttggagggcctcactgat

SEQ ID NO: 13669 - DNA, 20 bp, Artificial Sequence
  Description of Artificial Sequence: Synthetic oligonucleotide
  Target: AGXT; (-) strand; PAM type: YTN; PAM sequence: TTT
tatttggagggcctcactga

SEQ ID NO: 13670 - DNA, 20 bp, Artificial Sequence
  Description of Artificial Sequence: Synthetic oligonucleotide
  Target: AGXT; (-) strand; PAM type: YTN; PAM sequence: CTG
tgggtggtaagcagcatgta

SEQ ID NO: 13671 - DNA, 20 bp, Artificial Sequence
  Description of Artificial Sequence: Synthetic oligonucleotide
  Target: AGXT; (-) strand; PAM type: YTN; PAM sequence: TTG
gatgactgtgggtggtaagc

SEQ ID NO: 13672 - DNA, 20 bp, Artificial Sequence
  Description of Artificial Sequence: Synthetic oligonucleotide
  Target: AGXT; (-) strand; PAM type: YTN; PAM sequence: CTT
ggatgactgtgggtggtaag

SEQ ID NO: 13673 - DNA, 20 bp, Artificial Sequence
  Description of Artificial Sequence: Synthetic oligonucleotide
  Target: AGXT; (-) strand; PAM type: YTN; PAM sequence: TTG
gcccttggatgactgtgggt

SEQ ID NO: 13674 - DNA, 20 bp, Artificial Sequence
  Description of Artificial Sequence: Synthetic oligonucleotide
  Target: AGXT; (-) strand; PAM type: YTN; PAM sequence: CTT
ggcccttggatgactgtggg

SEQ ID NO: 13675 - DNA, 20 bp, Artificial Sequence
  Description of Artificial Sequence: Synthetic oligonucleotide
  Target: AGXT; (-) strand; PAM type: YTN; PAM sequence: CTA
gcttggcccttggatgactg

SEQ ID NO: 13676 - DNA, 20 bp, Artificial Sequence
  Description of Artificial Sequence: Synthetic oligonucleotide
  Target: AGXT; (-) strand; PAM type: YTN; PAM sequence: TTC
aaagctagcttggcccttgg

SEQ ID NO: 13677 - DNA, 20 bp, Artificial Sequence
  Description of Artificial Sequence: Synthetic oligonucleotide
  Target: AGXT; (-) strand; PAM type: YTN; PAM sequence: TTT
caaagctagcttggcccttg

SEQ ID NO: 13678 - DNA, 20 bp, Artificial Sequence
  Description of Artificial Sequence: Synthetic oligonucleotide
  Target: AGXT; (-) strand; PAM type: YTN; PAM sequence: TTT
tcaaagctagcttggccctt

SEQ ID NO: 13679 - DNA, 20 bp, Artificial Sequence
  Description of Artificial Sequence: Synthetic oligonucleotide
  Target: AGXT; (-) strand; PAM type: YTN; PAM sequence: TTA
gtgagaagggttttcaaagc

SEQ ID NO: 13680 - DNA, 20 bp, Artificial Sequence
  Description of Artificial Sequence: Synthetic oligonucleotide
  Target: AGXT; (-) strand; PAM type: YTN; PAM sequence: CTT
agtgagaagggttttcaaag

SEQ ID NO: 13681 - DNA, 20 bp, Artificial Sequence
  Description of Artificial Sequence: Synthetic oligonucleotide
  Target: AGXT; (-) strand; PAM type: YTN; PAM sequence: CTA
tagagagcttagtgagaagg

SEQ ID NO: 13682 - DNA, 20 bp, Artificial Sequence
  Description of Artificial Sequence: Synthetic oligonucleotide
  Target: AGXT; (-) strand; PAM type: YTN; PAM sequence: TTC
tatagagagcttagtgagaa

SEQ ID NO: 13683 - DNA, 20 bp, Artificial Sequence
  Description of Artificial Sequence: Synthetic oligonucleotide
  Target: AGXT; (-) strand; PAM type: YTN; PAM sequence: TTT
ctatagagagcttagtgaga

SEQ ID NO: 13684 - DNA, 20 bp, Artificial Sequence
  Description of Artificial Sequence: Synthetic oligonucleotide
  Target: AGXT; (-) strand; PAM type: YTN; PAM sequence: TTG
agtttctatagagagcttag

SEQ ID NO: 13685 - DNA, 20 bp, Artificial Sequence
  Description of Artificial Sequence: Synthetic oligonucleotide
  Target: AGXT; (-) strand; PAM type: YTN; PAM sequence: TTA
tccaaaacagttgagtttct

SEQ ID NO: 13686 - DNA, 20 bp, Artificial Sequence
  Description of Artificial Sequence: Synthetic oligonucleotide
  Target: AGXT; (-) strand; PAM type: YTN; PAM sequence: TTA
acagggcaataggaagaaaa

SEQ ID NO: 13687 - DNA, 20 bp, Artificial Sequence
  Description of Artificial Sequence: Synthetic oligonucleotide
  Target: AGXT; (-) strand; PAM type: YTN; PAM sequence: CTT
aacagggcaataggaagaaa

SEQ ID NO: 13688 - DNA, 20 bp, Artificial Sequence
  Description of Artificial Sequence: Synthetic oligonucleotide
  Target: AGXT; (-) strand; PAM type: YTN; PAM sequence: CTA
gatcttaacagggcaatagg

SEQ ID NO: 13689 - DNA, 20 bp, Artificial Sequence
  Description of Artificial Sequence: Synthetic oligonucleotide
  Target: AGXT; (-) strand; PAM type: YTN; PAM sequence: CTC
tagatcttaacagggcaata

SEQ ID NO: 13690 - DNA, 20 bp, Artificial Sequence
  Description of Artificial Sequence: Synthetic oligonucleotide
  Target: AGXT; (-) strand; PAM type: YTN; PAM sequence: TTA
ctctagatcttaacagggca

SEQ ID NO: 13691 - DNA, 20 bp, Artificial Sequence
  Description of Artificial Sequence: Synthetic oligonucleotide
  Target: AGXT; (-) strand; PAM type: YTN; PAM sequence: TTG
ggaattactctagatcttaa

SEQ ID NO: 13692 - DNA, 20 bp, Artificial Sequence
  Description of Artificial Sequence: Synthetic oligonucleotide
  Target: AGXT; (-) strand; PAM type: YTN; PAM sequence: TTT
gggaattactctagatctta

SEQ ID NO: 13693 - DNA, 20 bp, Artificial Sequence
  Description of Artificial Sequence: Synthetic oligonucleotide
  Target: AGXT; (-) strand; PAM type: YTN; PAM sequence: CTT
tgggaattactctagatctt

SEQ ID NO: 13694 - DNA, 20 bp, Artificial Sequence
  Description of Artificial Sequence: Synthetic oligonucleotide
  Target: AGXT; (-) strand; PAM type: YTN; PAM sequence: TTG
aaacctttgggaattactct

SEQ ID NO: 13695 - DNA, 20 bp, Artificial Sequence
  Description of Artificial Sequence: Synthetic oligonucleotide
  Target: AGXT; (-) strand; PAM type: YTN; PAM sequence: CTA
aggtgggttgaaacctttgg

SEQ ID NO: 13696 - DNA, 20 bp, Artificial Sequence
  Description of Artificial Sequence: Synthetic oligonucleotide
  Target: AGXT; (-) strand; PAM type: YTN; PAM sequence: TTC
aaaagggctaaggtgggttg

SEQ ID NO: 13697 - DNA, 20 bp, Artificial Sequence
  Description of Artificial Sequence: Synthetic oligonucleotide
  Target: AGXT; (-) strand; PAM type: YTN; PAM sequence: TTT
caaaagggctaaggtgggtt

SEQ ID NO: 13698 - DNA, 20 bp, Artificial Sequence
  Description of Artificial Sequence: Synthetic oligonucleotide
  Target: AGXT; (-) strand; PAM type: YTN; PAM sequence: TTG
taaaaaggggcatccataaa

SEQ ID NO: 13699 - DNA, 20 bp, Artificial Sequence
  Description of Artificial Sequence: Synthetic oligonucleotide
  Target: AGXT; (-) strand; PAM type: YTN; PAM sequence: TTT
gtaaaaaggggcatccataa

SEQ ID NO: 13700 - DNA, 20 bp, Artificial Sequence
  Description of Artificial Sequence: Synthetic oligonucleotide
  Target: AGXT; (-) strand; PAM type: YTN; PAM sequence: CTG
gatcaagtaataagtccgtt

SEQ ID NO: 13701 - DNA, 20 bp, Artificial Sequence
  Description of Artificial Sequence: Synthetic oligonucleotide
  Target: AGXT; (-) strand; PAM type: YTN; PAM sequence: CTC
tggatcaagtaataagtccg

SEQ ID NO: 13702 - DNA, 20 bp, Artificial Sequence
  Description of Artificial Sequence: Synthetic oligonucleotide
  Target: AGXT; (-) strand; PAM type: YTN; PAM sequence: TTG
agacagataatgagcctctg

SEQ ID NO: 13703 - DNA, 20 bp, Artificial Sequence
  Description of Artificial Sequence: Synthetic oligonucleotide
  Target: AGXT; (-) strand; PAM type: YTN; PAM sequence: TTG
cccagggaggcatcacattg

SEQ ID NO: 13704 - DNA, 20 bp, Artificial Sequence
  Description of Artificial Sequence: Synthetic oligonucleotide
  Target: AGXT; (-) strand; PAM type: YTN; PAM sequence: TTT
gcccagggaggcatcacatt

SEQ ID NO: 13705 - DNA, 20 bp, Artificial Sequence
  Description of Artificial Sequence: Synthetic oligonucleotide
  Target: AGXT; (-) strand; PAM type: YTN; PAM sequence: CTG
gatagtttgcccagggaggc

SEQ ID NO: 13706 - DNA, 20 bp, Artificial Sequence
  Description of Artificial Sequence: Synthetic oligonucleotide
  Target: AGXT; (-) strand; PAM type: YTN; PAM sequence: TTC
agtagtggcctggatagttt

SEQ ID NO: 13707 - DNA, 20 bp, Artificial Sequence
  Description of Artificial Sequence: Synthetic oligonucleotide
  Target: AGXT; (-) strand; PAM type: YTN; PAM sequence: CTG
gtattcagtagtggcctgga

SEQ ID NO: 13708 - DNA, 20 bp, Artificial Sequence
  Description of Artificial Sequence: Synthetic oligonucleotide
  Target: AGXT; (-) strand; PAM type: YTN; PAM sequence: TTA
tcctggtattcagtagtggc

SEQ ID NO: 13709 - DNA, 20 bp, Artificial Sequence
  Description of Artificial Sequence: Synthetic oligonucleotide
  Target: AGXT; (-) strand; PAM type: YTN; PAM sequence: TTT
atcctggtattcagtagtgg

SEQ ID NO: 13710 - DNA, 20 bp, Artificial Sequence
  Description of Artificial Sequence: Synthetic oligonucleotide
  Target: AGXT; (-) strand; PAM type: YTN; PAM sequence: TTG
gacaaaatttatcctggtat

SEQ ID NO: 13711 - DNA, 20 bp, Artificial Sequence
  Description of Artificial Sequence: Synthetic oligonucleotide
  Target: AGXT; (-) strand; PAM type: YTN; PAM sequence: TTT
ggacaaaatttatcctggta

SEQ ID NO: 13712 - DNA, 20 bp, Artificial Sequence
  Description of Artificial Sequence: Synthetic oligonucleotide
  Target: AGXT; (-) strand; PAM type: YTN; PAM sequence: TTT
tggacaaaatttatcctggt

SEQ ID NO: 13713 - DNA, 20 bp, Artificial Sequence
  Description of Artificial Sequence: Synthetic oligonucleotide
  Target: AGXT; (-) strand; PAM type: YTN; PAM sequence: CTG
atgaggaggggtcagatttt

SEQ ID NO: 13714 - DNA, 20 bp, Artificial Sequence
  Description of Artificial Sequence: Synthetic oligonucleotide
  Target: AGXT; (-) strand; PAM type: YTN; PAM sequence: TTC
tgatgaggaggggtcagatt

SEQ ID NO: 13715 - DNA, 20 bp, Artificial Sequence
  Description of Artificial Sequence: Synthetic oligonucleotide
  Target: AGXT; (-) strand; PAM type: YTN; PAM sequence: TTA
gttctgatgaggaggggtca

SEQ ID NO: 13716 - DNA, 20 bp, Artificial Sequence
  Description of Artificial Sequence: Synthetic oligonucleotide
  Target: AGXT; (-) strand; PAM type: YTN; PAM sequence: CTT
agttctgatgaggaggggtc

SEQ ID NO: 13717 - DNA, 20 bp, Artificial Sequence
  Description of Artificial Sequence: Synthetic oligonucleotide
  Target: AGXT; (-) strand; PAM type: YTN; PAM sequence: TTA
acaggaggtcttagttctga

SEQ ID NO: 13718 - DNA, 20 bp, Artificial Sequence
  Description of Artificial Sequence: Synthetic oligonucleotide
  Target: AGXT; (-) strand; PAM type: YTN; PAM sequence: TTA
aatatacccagtccccaggt

SEQ ID NO: 13719 - DNA, 20 bp, Artificial Sequence
  Description of Artificial Sequence: Synthetic oligonucleotide
  Target: AGXT; (-) strand; PAM type: YTN; PAM sequence: TTT
aaatatacccagtccccagg

SEQ ID NO: 13720 - DNA, 20 bp, Artificial Sequence
  Description of Artificial Sequence: Synthetic oligonucleotide
  Target: AGXT; (-) strand; PAM type: YTN; PAM sequence: TTT
taaatatacccagtccccag

SEQ ID NO: 13721 - DNA, 20 bp, Artificial Sequence
  Description of Artificial Sequence: Synthetic oligonucleotide
  Target: AGXT; (-) strand; PAM type: YTN; PAM sequence: TTT
ttaaatatacccagtcccca

SEQ ID NO: 13722 - DNA, 20 bp, Artificial Sequence
  Description of Artificial Sequence: Synthetic oligonucleotide
  Target: AGXT; (-) strand; PAM type: YTN; PAM sequence: CTG
gaggcaaagtttttaaatat

SEQ ID NO: 13723 - DNA, 20 bp, Artificial Sequence
  Description of Artificial Sequence: Synthetic oligonucleotide
  Target: AGXT; (-) strand; PAM type: YTN; PAM sequence: CTG
tctggaggcaaagtttttaa

SEQ ID NO: 13724 - DNA, 20 bp, Artificial Sequence
  Description of Artificial Sequence: Synthetic oligonucleotide
  Target: AGXT; (-) strand; PAM type: YTN; PAM sequence: TTC
tgtctggaggcaaagttttt

SEQ ID NO: 13725 - DNA, 20 bp, Artificial Sequence
  Description of Artificial Sequence: Synthetic oligonucleotide
  Target: AGXT; (-) strand; PAM type: YTN; PAM sequence: TTT
ctgtctggaggcaaagtttt

SEQ ID NO: 13726 - DNA, 20 bp, Artificial Sequence
  Description of Artificial Sequence: Synthetic oligonucleotide
  Target: AGXT; (-) strand; PAM type: YTN; PAM sequence: TTT
tctgtctggaggcaaagttt

SEQ ID NO: 13727 - DNA, 20 bp, Artificial Sequence
  Description of Artificial Sequence: Synthetic oligonucleotide
  Target: AGXT; (-) strand; PAM type: YTN; PAM sequence: CTG
gaaggggttttctgtctgga

SEQ ID NO: 13728 - DNA, 20 bp, Artificial Sequence
  Description of Artificial Sequence: Synthetic oligonucleotide
  Target: AGXT; (-) strand; PAM type: YTN; PAM sequence: TTG
aaagggtccagtccagaggg

SEQ ID NO: 13729 - DNA, 20 bp, Artificial Sequence
  Description of Artificial Sequence: Synthetic oligonucleotide
  Target: AGXT; (-) strand; PAM type: YTN; PAM sequence: CTT
gaaagggtccagtccagagg

SEQ ID NO: 13730 - DNA, 20 bp, Artificial Sequence
  Description of Artificial Sequence: Synthetic oligonucleotide
  Target: AGXT; (-) strand; PAM type: YTN; PAM sequence: CTA
tgaggacttgaaagggtcca

SEQ ID NO: 13731 - DNA, 20 bp, Artificial Sequence
  Description of Artificial Sequence: Synthetic oligonucleotide
  Target: AGXT; (-) strand; PAM type: YTN; PAM sequence: CTG
tgggagaggctatgaggact

SEQ ID NO: 13732 - DNA, 20 bp, Artificial Sequence
  Description of Artificial Sequence: Synthetic oligonucleotide
  Target: AGXT; (-) strand; PAM type: YTN; PAM sequence: TTA
acagctgtgggagaggctat

SEQ ID NO: 13733 - DNA, 20 bp, Artificial Sequence
  Description of Artificial Sequence: Synthetic oligonucleotide
  Target: AGXT; (-) strand; PAM type: YTN; PAM sequence: CTG
cagttaacagctgtgggaga

SEQ ID NO: 13734 - DNA, 20 bp, Artificial Sequence
  Description of Artificial Sequence: Synthetic oligonucleotide
  Target: AGXT; (-) strand; PAM type: YTN; PAM sequence: TTA
tgtggcaaaggtggacccaa

SEQ ID NO: 13735 - DNA, 20 bp, Artificial Sequence
  Description of Artificial Sequence: Synthetic oligonucleotide
  Target: AGXT; (-) strand; PAM type: YTN; PAM sequence: TTT
atgtggcaaaggtggaccca

SEQ ID NO: 13736 - DNA, 20 bp, Artificial Sequence
  Description of Artificial Sequence: Synthetic oligonucleotide
  Target: AGXT; (-) strand; PAM type: YTN; PAM sequence: CTT
tatgtggcaaaggtggaccc

SEQ ID NO: 13737 - DNA, 20 bp, Artificial Sequence
  Description of Artificial Sequence: Synthetic oligonucleotide
  Target: AGXT; (-) strand; PAM type: YTN; PAM sequence: CTG
gcggcagtacagactttatg

SEQ ID NO: 13738 - DNA, 20 bp, Artificial Sequence
  Description of Artificial Sequence: Synthetic oligonucleotide
  Target: AGXT; (-) strand; PAM type: YTN; PAM sequence: TTC
tggcggcagtacagacttta

SEQ ID NO: 13739 - DNA, 20 bp, Artificial Sequence
  Description of Artificial Sequence: Synthetic oligonucleotide
  Target: AGXT; (-) strand; PAM type: YTN; PAM sequence: CTG
gagttctggcggcagtacag

SEQ ID NO: 13740 - DNA, 20 bp, Artificial Sequence
  Description of Artificial Sequence: Synthetic oligonucleotide
  Target: AGXT; (-) strand; PAM type: YTN; PAM sequence: CTC
aaagtgtaagcaggctggag

SEQ ID NO: 13741 - DNA, 20 bp, Artificial Sequence
  Description of Artificial Sequence: Synthetic oligonucleotide
  Target: AGXT; (-) strand; PAM type: YTN; PAM sequence: TTC
caagggctcaaagtgtaagc

SEQ ID NO: 13742 - DNA, 20 bp, Artificial Sequence
  Description of Artificial Sequence: Synthetic oligonucleotide
  Target: AGXT; (-) strand; PAM type: YTN; PAM sequence: CTT
ccaagggctcaaagtgtaag

SEQ ID NO: 13743 - DNA, 20 bp, Artificial Sequence
  Description of Artificial Sequence: Synthetic oligonucleotide
  Target: AGXT; (-) strand; PAM type: YTN; PAM sequence: TTG
caaaacaaaaatcatagatc

SEQ ID NO: 13744 - DNA, 20 bp, Artificial Sequence
  Description of Artificial Sequence: Synthetic oligonucleotide
  Target: AGXT; (-) strand; PAM type: YTN; PAM sequence: TTT
gcaaaacaaaaatcatagat

SEQ ID NO: 13745 - DNA, 20 bp, Artificial Sequence
  Description of Artificial Sequence: Synthetic oligonucleotide
  Target: AGXT; (-) strand; PAM type: YTN; PAM sequence: TTG
tttgcaaaacaaaaatcata

SEQ ID NO: 13746 - DNA, 20 bp, Artificial Sequence
  Description of Artificial Sequence: Synthetic oligonucleotide
  Target: AGXT; (-) strand; PAM type: YTN; PAM sequence: CTG
gttgtttgcaaaacaaaaat

SEQ ID NO: 13747 - DNA, 20 bp, Artificial Sequence
  Description of Artificial Sequence: Synthetic oligonucleotide
  Target: AGXT; (-) strand; PAM type: YTN; PAM sequence: TTA
gtgtcacctggttgtttgca

SEQ ID NO: 13748 - DNA, 20 bp, Artificial Sequence
  Description of Artificial Sequence: Synthetic oligonucleotide
  Target: AGXT; (-) strand; PAM type: YTN; PAM sequence: TTG
aagagaggttagtgtcacct

SEQ ID NO: 13749 - DNA, 20 bp, Artificial Sequence
  Description of Artificial Sequence: Synthetic oligonucleotide
  Target: AGXT; (-) strand; PAM type: YTN; PAM sequence: TTT
gaagagaggttagtgtcacc

SEQ ID NO: 13750 - DNA, 20 bp, Artificial Sequence
  Description of Artificial Sequence: Synthetic oligonucleotide
  Target: AGXT; (-) strand; PAM type: YTN; PAM sequence: TTT
tgaagagaggttagtgtcac

SEQ ID NO: 13751 - DNA, 20 bp, Artificial Sequence
  Description of Artificial Sequence: Synthetic oligonucleotide
  Target: AGXT; (-) strand; PAM type: YTN; PAM sequence: CTT
ttgaagagaggttagtgtca

SEQ ID NO: 13752 - DNA, 20 bp, Artificial Sequence
  Description of Artificial Sequence: Synthetic oligonucleotide
  Target: AGXT; (-) strand; PAM type: YTN; PAM sequence: TTG
cttttgaagagaggttagtg

SEQ ID NO: 13753 - DNA, 20 bp, Artificial Sequence
  Description of Artificial Sequence: Synthetic oligonucleotide
  Target: AGXT; (-) strand; PAM type: YTN; PAM sequence: TTT
gcttttgaagagaggttagt

SEQ ID NO: 13754 - DNA, 20 bp, Artificial Sequence
  Description of Artificial Sequence: Synthetic oligonucleotide
  Target: AGXT; (-) strand; PAM type: YTN; PAM sequence: CTT
tgcttttgaagagaggttag

SEQ ID NO: 13755 - DNA, 20 bp, Artificial Sequence
  Description of Artificial Sequence: Synthetic oligonucleotide
  Target: AGXT; (-) strand; PAM type: YTN; PAM sequence: TTA
cgtggtatcctttgcttttg

SEQ ID NO: 13756 - DNA, 20 bp, Artificial Sequence
  Description of Artificial Sequence: Synthetic oligonucleotide
  Target: AGXT; (-) strand; PAM type: YTN; PAM sequence: CTT
acgtggtatcctttgctttt

SEQ ID NO: 13757 - DNA, 20 bp, Artificial Sequence
  Description of Artificial Sequence: Synthetic oligonucleotide
  Target: AGXT; (-) strand; PAM type: YTN; PAM sequence: CTA
gagtacataaggaaatgaat

SEQ ID NO: 13758 - DNA, 20 bp, Artificial Sequence
  Description of Artificial Sequence: Synthetic oligonucleotide
  Target: AGXT; (-) strand; PAM type: YTN; PAM sequence: TTC
tagagtacataaggaaatga

SEQ ID NO: 13759 - DNA, 20 bp, Artificial Sequence
  Description of Artificial Sequence: Synthetic oligonucleotide
  Target: AGXT; (-) strand; PAM type: YTN; PAM sequence: CTT
ctagagtacataaggaaatg

SEQ ID NO: 13760 - DNA, 20 bp, Artificial Sequence
  Description of Artificial Sequence: Synthetic oligonucleotide
  Target: AGXT; (-) strand; PAM type: YTN; PAM sequence: CTA
aaaacgcttctagagtacat

SEQ ID NO: 13761 - DNA, 20 bp, Artificial Sequence
  Description of Artificial Sequence: Synthetic oligonucleotide
  Target: AGXT; (-) strand; PAM type: YTN; PAM sequence: TTG
gaggacctaaaaacgcttct

SEQ ID NO: 13762 - DNA, 20 bp, Artificial Sequence
  Description of Artificial Sequence: Synthetic oligonucleotide
  Target: AGXT; (-) strand; PAM type: YTN; PAM sequence: CTC
agaaaattggaggacctaaa

SEQ ID NO: 13763 - DNA, 20 bp, Artificial Sequence
  Description of Artificial Sequence: Synthetic oligonucleotide
  Target: AGXT; (-) strand; PAM type: YTN; PAM sequence: TTG
aggataatctcagaaaattg

SEQ ID NO: 13764 - DNA, 20 bp, Artificial Sequence
  Description of Artificial Sequence: Synthetic oligonucleotide
  Target: AGXT; (-) strand; PAM type: YTN; PAM sequence: CTC
aaaaaaaaaaaaaaaaaaaa

SEQ ID NO: 13765 - DNA, 20 bp, Artificial Sequence
  Description of Artificial Sequence: Synthetic oligonucleotide
  Target: AGXT; (-) strand; PAM type: YTN; PAM sequence: CTG
tctcaaaaaaaaaaaaaaaa

SEQ ID NO: 13766 - DNA, 20 bp, Artificial Sequence
  Description of Artificial Sequence: Synthetic oligonucleotide
  Target: AGXT; (-) strand; PAM type: YTN; PAM sequence: CTC
tgtctcaaaaaaaaaaaaaa

SEQ ID NO: 13767 - DNA, 20 bp, Artificial Sequence
  Description of Artificial Sequence: Synthetic oligonucleotide
  Target: AGXT; (-) strand; PAM type: YTN; PAM sequence: CTG
ggtgacaagagcaaaactct

SEQ ID NO: 13768 - DNA, 20 bp, Artificial Sequence
  Description of Artificial Sequence: Synthetic oligonucleotide
  Target: AGXT; (-) strand; PAM type: YTN; PAM sequence: CTA
tagcctgggtgacaagagca

SEQ ID NO: 13769 - DNA, 20 bp, Artificial Sequence
  Description of Artificial Sequence: Synthetic oligonucleotide
  Target: AGXT; (-) strand; PAM type: YTN; PAM sequence: TTG
cactatagcctgggtgacaa

SEQ ID NO: 13770 - DNA, 20 bp, Artificial Sequence
  Description of Artificial Sequence: Synthetic oligonucleotide
  Target: AGXT; (-) strand; PAM type: YTN; PAM sequence: TTG
cagtgagccgagatcgcacc

SEQ ID NO: 13771 - DNA, 20 bp, Artificial Sequence
  Description of Artificial Sequence: Synthetic oligonucleotide
  Target: AGXT; (-) strand; PAM type: YTN; PAM sequence: TTG
aacccgggagatggcggttg

SEQ ID NO: 13772 - DNA, 20 bp, Artificial Sequence
  Description of Artificial Sequence: Synthetic oligonucleotide
  Target: AGXT; (-) strand; PAM type: YTN; PAM sequence: CTT
gaacccgggagatggcggtt

SEQ ID NO: 13773 - DNA, 20 bp, Artificial Sequence
  Description of Artificial Sequence: Synthetic oligonucleotide
  Target: AGXT; (-) strand; PAM type: YTN; PAM sequence: TTG
aggcgggagaatcacttgaa

SEQ ID NO: 13774 - DNA, 20 bp, Artificial Sequence
  Description of Artificial Sequence: Synthetic oligonucleotide
  Target: AGXT; (-) strand; PAM type: YTN; PAM sequence: CTC
aggaggttgaggcgggagaa

SEQ ID NO: 13775 - DNA, 20 bp, Artificial Sequence
  Description of Artificial Sequence: Synthetic oligonucleotide
  Target: AGXT; (-) strand; PAM type: YTN; PAM sequence: CTA
ctcaggaggttgaggcggga

SEQ ID NO: 13776 - DNA, 20 bp, Artificial Sequence
  Description of Artificial Sequence: Synthetic oligonucleotide
  Target: AGXT; (-) strand; PAM type: YTN; PAM sequence: CTG
taatcccagctactcaggag

SEQ ID NO: 13777 - DNA, 20 bp, Artificial Sequence
  Description of Artificial Sequence: Synthetic oligonucleotide
  Target: AGXT; (-) strand; PAM type: YTN; PAM sequence: CTA
aaaatacaaaaaaaaaaaaa

SEQ ID NO: 13778 - DNA, 20 bp, Artificial Sequence
  Description of Artificial Sequence: Synthetic oligonucleotide
  Target: AGXT; (-) strand; PAM type: YTN; PAM sequence: CTA
ctaaaaatacaaaaaaaaaa

SEQ ID NO: 13779 - DNA, 20 bp, Artificial Sequence
  Description of Artificial Sequence: Synthetic oligonucleotide
  Target: AGXT; (-) strand; PAM type: YTN; PAM sequence: CTC
tactaaaaatacaaaaaaaa

SEQ ID NO: 13780 - DNA, 20 bp, Artificial Sequence
  Description of Artificial Sequence: Synthetic oligonucleotide
  Target: AGXT; (-) strand; PAM type: YTN; PAM sequence: CTG
tctctactaaaaatacaaaa

SEQ ID NO: 13781 - DNA, 20 bp, Artificial Sequence
  Description of Artificial Sequence: Synthetic oligonucleotide
  Target: AGXT; (-) strand; PAM type: YTN; PAM sequence: CTG
gccaacatggtgaaaccctg

SEQ ID NO: 13782 - DNA, 20 bp, Artificial Sequence
  Description of Artificial Sequence: Synthetic oligonucleotide
  Target: AGXT; (-) strand; PAM type: YTN; PAM sequence: CTG
aggtcagaagtgtgagaaca

SEQ ID NO: 13783 - DNA, 20 bp, Artificial Sequence
  Description of Artificial Sequence: Synthetic oligonucleotide
  Target: AGXT; (-) strand; PAM type: YTN; PAM sequence: CTG
agacgggcggatcacctgag

SEQ ID NO: 13784 - DNA, 20 bp, Artificial Sequence
  Description of Artificial Sequence: Synthetic oligonucleotide
  Target: AGXT; (-) strand; PAM type: YTN; PAM sequence: TTG
ggaggctgagacgggcggat

SEQ ID NO: 13785 - DNA, 20 bp, Artificial Sequence
  Description of Artificial Sequence: Synthetic oligonucleotide
  Target: AGXT; (-) strand; PAM type: YTN; PAM sequence: TTT
gggaggctgagacgggcgga

SEQ ID NO: 13786 - DNA, 20 bp, Artificial Sequence
  Description of Artificial Sequence: Synthetic oligonucleotide
  Target: AGXT; (-) strand; PAM type: YTN; PAM sequence: CTT
tgggaggctgagacgggcgg

SEQ ID NO: 13787 - DNA, 20 bp, Artificial Sequence
  Description of Artificial Sequence: Synthetic oligonucleotide
  Target: AGXT; (-) strand; PAM type: YTN; PAM sequence: TTC
cagcactttgggaggctgag

SEQ ID NO: 13788 - DNA, 20 bp, Artificial Sequence
  Description of Artificial Sequence: Synthetic oligonucleotide
  Target: AGXT; (-) strand; PAM type: YTN; PAM sequence: CTG
taattccagcactttgggag

SEQ ID NO: 13789 - DNA, 20 bp, Artificial Sequence
  Description of Artificial Sequence: Synthetic oligonucleotide
  Target: AGXT; (-) strand; PAM type: YTN; PAM sequence: CTC
atgcctgtaattccagcact

SEQ ID NO: 13790 - DNA, 20 bp, Artificial Sequence
  Description of Artificial Sequence: Synthetic oligonucleotide
  Target: AGXT; (-) strand; PAM type: YTN; PAM sequence: CTG
ggtgtggtggctcatgcctg

SEQ ID NO: 13791 - DNA, 20 bp, Artificial Sequence
  Description of Artificial Sequence: Synthetic oligonucleotide
  Target: AGXT; (-) strand; PAM type: YTN; PAM sequence: TTG
gctgggtgtggtggctcatg

SEQ ID NO: 13792 - DNA, 20 bp, Artificial Sequence
  Description of Artificial Sequence: Synthetic oligonucleotide
  Target: AGXT; (-) strand; PAM type: YTN; PAM sequence: TTG
gataaagagacagtaaattg

SEQ ID NO: 13793 - DNA, 20 bp, Artificial Sequence
  Description of Artificial Sequence: Synthetic oligonucleotide
  Target: AGXT; (-) strand; PAM type: YTN; PAM sequence: TTG
agaaatggggattggataaa

SEQ ID NO: 13794 - DNA, 20 bp, Artificial Sequence
  Description of Artificial Sequence: Synthetic oligonucleotide
  Target: AGXT; (-) strand; PAM type: YTN; PAM sequence: CTT
gagaaatggggattggataa

SEQ ID NO: 13795 - DNA, 20 bp, Artificial Sequence
  Description of Artificial Sequence: Synthetic oligonucleotide
  Target: AGXT; (-) strand; PAM type: YTN; PAM sequence: TTG
tatgtgggtcttgagaaatg

SEQ ID NO: 13796 - DNA, 20 bp, Artificial Sequence
  Description of Artificial Sequence: Synthetic oligonucleotide
  Target: AGXT; (-) strand; PAM type: YTN; PAM sequence: CTG
aataattgtatgtgggtctt

SEQ ID NO: 13797 - DNA, 20 bp, Artificial Sequence
  Description of Artificial Sequence: Synthetic oligonucleotide
  Target: AGXT; (-) strand; PAM type: YTN; PAM sequence: CTA
gtgcaagctgaataattgta

SEQ ID NO: 13798 - DNA, 20 bp, Artificial Sequence
  Description of Artificial Sequence: Synthetic oligonucleotide
  Target: AGXT; (-) strand; PAM type: YTN; PAM sequence: CTG
caaataaaaatctagtgcaa

SEQ ID NO: 13799 - DNA, 20 bp, Artificial Sequence
  Description of Artificial Sequence: Synthetic oligonucleotide
  Target: AGXT; (-) strand; PAM type: YTN; PAM sequence: TTA
gaaaaaccaccctgcaaata

SEQ ID NO: 13800 - DNA, 20 bp, Artificial Sequence
  Description of Artificial Sequence: Synthetic oligonucleotide
  Target: AGXT; (-) strand; PAM type: YTN; PAM sequence: CTC
caagtataattagaaaaacc

SEQ ID NO: 13801 - DNA, 20 bp, Artificial Sequence
  Description of Artificial Sequence: Synthetic oligonucleotide
  Target: AGXT; (-) strand; PAM type: YTN; PAM sequence: TTG
ctccaagtataattagaaaa

SEQ ID NO: 13802 - DNA, 20 bp, Artificial Sequence
  Description of Artificial Sequence: Synthetic oligonucleotide
  Target: AGXT; (-) strand; PAM type: YTN; PAM sequence: TTA
caaaagttgctccaagtata

SEQ ID NO: 13803 - DNA, 20 bp, Artificial Sequence
  Description of Artificial Sequence: Synthetic oligonucleotide
  Target: AGXT; (-) strand; PAM type: YTN; PAM sequence: CTG
ttacaaaagttgctccaagt

SEQ ID NO: 13804 - DNA, 20 bp, Artificial Sequence
  Description of Artificial Sequence: Synthetic oligonucleotide
  Target: AGXT; (-) strand; PAM type: YTN; PAM sequence: TTC
aaggactgttacaaaagttg

SEQ ID NO: 13805 - DNA, 20 bp, Artificial Sequence
  Description of Artificial Sequence: Synthetic oligonucleotide
  Target: AGXT; (-) strand; PAM type: YTN; PAM sequence: CTA
attcaaggactgttacaaaa

SEQ ID NO: 13806 - DNA, 20 bp, Artificial Sequence
  Description of Artificial Sequence: Synthetic oligonucleotide
  Target: AGXT; (-) strand; PAM type: YTN; PAM sequence: TTC
taattcaaggactgttacaa

SEQ ID NO: 13807 - DNA, 20 bp, Artificial Sequence
  Description of Artificial Sequence: Synthetic oligonucleotide
  Target: AGXT; (-) strand; PAM type: YTN; PAM sequence: TTG
ttctaattcaaggactgtta

SEQ ID NO: 13808 - DNA, 20 bp, Artificial Sequence
  Description of Artificial Sequence: Synthetic oligonucleotide
  Target: AGXT; (-) strand; PAM type: YTN; PAM sequence: CTC
attgttctaattcaaggact

SEQ ID NO: 13809 - DNA, 20 bp, Artificial Sequence
  Description of Artificial Sequence: Synthetic oligonucleotide
  Target: AGXT; (-) strand; PAM type: YTN; PAM sequence: TTA
tatgagagataaagagaaaa

SEQ ID NO: 13810 - DNA, 20 bp, Artificial Sequence
  Description of Artificial Sequence: Synthetic oligonucleotide
  Target: AGXT; (-) strand; PAM type: YTN; PAM sequence: TTT
atatgagagataaagagaaa

SEQ ID NO: 13811 - DNA, 20 bp, Artificial Sequence
  Description of Artificial Sequence: Synthetic oligonucleotide
  Target: AGXT; (-) strand; PAM type: YTN; PAM sequence: TTT
tatatgagagataaagagaa

SEQ ID NO: 13812 - DNA, 20 bp, Artificial Sequence
  Description of Artificial Sequence: Synthetic oligonucleotide
  Target: AGXT; (-) strand; PAM type: YTN; PAM sequence: TTT
ttatatgagagataaagaga

SEQ ID NO: 13813 - DNA, 20 bp, Artificial Sequence
  Description of Artificial Sequence: Synthetic oligonucleotide
  Target: AGXT; (-) strand; PAM type: YTN; PAM sequence: TTG
ggaagtttttatatgagaga

SEQ ID NO: 13814 - DNA, 20 bp, Artificial Sequence
  Description of Artificial Sequence: Synthetic oligonucleotide
  Target: AGXT; (-) strand; PAM type: YTN; PAM sequence: TTG
tcaaaccaagaggattggga

SEQ ID NO: 13815 - DNA, 20 bp, Artificial Sequence
  Description of Artificial Sequence: Synthetic oligonucleotide
  Target: AGXT; (-) strand; PAM type: YTN; PAM sequence: CTG
aagatgatattgtcaaacca

SEQ ID NO: 13816 - DNA, 20 bp, Artificial Sequence
  Description of Artificial Sequence: Synthetic oligonucleotide
  Target: AGXT; (-) strand; PAM type: YTN; PAM sequence: CTC
acaatagcatgtgagatgct

SEQ ID NO: 13817 - DNA, 20 bp, Artificial Sequence
  Description of Artificial Sequence: Synthetic oligonucleotide
  Target: AGXT; (-) strand; PAM type: YTN; PAM sequence: CTC
tcacaatagcatgtgagatg

SEQ ID NO: 13818 - DNA, 20 bp, Artificial Sequence
  Description of Artificial Sequence: Synthetic oligonucleotide
  Target: AGXT; (-) strand; PAM type: YTN; PAM sequence: CTC
ctctcacaatagcatgtgag

SEQ ID NO: 13819 - DNA, 20 bp, Artificial Sequence
  Description of Artificial Sequence: Synthetic oligonucleotide
  Target: AGXT; (-) strand; PAM type: YTN; PAM sequence: TTC
tcctctcacaatagcatgtg

SEQ ID NO: 13820 - DNA, 20 bp, Artificial Sequence
  Description of Artificial Sequence: Synthetic oligonucleotide
  Target: AGXT; (-) strand; PAM type: YTN; PAM sequence: TTT
ctcctctcacaatagcatgt

SEQ ID NO: 13821 - DNA, 20 bp, Artificial Sequence
  Description of Artificial Sequence: Synthetic oligonucleotide
  Target: AGXT; (-) strand; PAM type: YTN; PAM sequence: TTT
tctcctctcacaatagcatg

SEQ ID NO: 13822 - DNA, 20 bp, Artificial Sequence
  Description of Artificial Sequence: Synthetic oligonucleotide
  Target: AGXT; (-) strand; PAM type: YTN; PAM sequence: TTG
tggacggcaaagccagccac

SEQ ID NO: 13823 - DNA, 20 bp, Artificial Sequence
  Description of Artificial Sequence: Synthetic oligonucleotide
  Target: AGXT; (-) strand; PAM type: YTN; PAM sequence: TTG
gagtagcaggttgtggacgg

SEQ ID NO: 13824 - DNA, 20 bp, Artificial Sequence
  Description of Artificial Sequence: Synthetic oligonucleotide
  Target: AGXT; (-) strand; PAM type: YTN; PAM sequence: CTT
ggagtagcaggttgtggacg

SEQ ID NO: 13825 - DNA, 20 bp, Artificial Sequence
  Description of Artificial Sequence: Synthetic oligonucleotide
  Target: AGXT; (-) strand; PAM type: YTN; PAM sequence: CTA
catggcttggagtagcaggt

SEQ ID NO: 13826 - DNA, 20 bp, Artificial Sequence
  Description of Artificial Sequence: Synthetic oligonucleotide
  Target: AGXT; (-) strand; PAM type: YTN; PAM sequence: TTA
cgaagaagaatctacatggc

SEQ ID NO: 13827 - DNA, 20 bp, Artificial Sequence
  Description of Artificial Sequence: Synthetic oligonucleotide
  Target: AGXT; (-) strand; PAM type: YTN; PAM sequence: CTT
acgaagaagaatctacatgg

SEQ ID NO: 13828 - DNA, 20 bp, Artificial Sequence
  Description of Artificial Sequence: Synthetic oligonucleotide
  Target: AGXT; (-) strand; PAM type: YTN; PAM sequence: TTG
gagacagggtgtgcttacga

SEQ ID NO: 13829 - DNA, 20 bp, Artificial Sequence
  Description of Artificial Sequence: Synthetic oligonucleotide
  Target: AGXT; (-) strand; PAM type: YTN; PAM sequence: TTG
attggagacagggtgtgctt

SEQ ID NO: 13830 - DNA, 20 bp, Artificial Sequence
  Description of Artificial Sequence: Synthetic oligonucleotide
  Target: AGXT; (-) strand; PAM type: YTN; PAM sequence: TTT
gattggagacagggtgtgct

SEQ ID NO: 13831 - DNA, 20 bp, Artificial Sequence
  Description of Artificial Sequence: Synthetic oligonucleotide
  Target: AGXT; (-) strand; PAM type: YTN; PAM sequence: TTA
ccagcacagaaggaaatggt

SEQ ID NO: 13832 - DNA, 20 bp, Artificial Sequence
  Description of Artificial Sequence: Synthetic oligonucleotide
  Target: AGXT; (-) strand; PAM type: YTN; PAM sequence: TTT
accagcacagaaggaaatgg

SEQ ID NO: 13833 - DNA, 20 bp, Artificial Sequence
  Description of Artificial Sequence: Synthetic oligonucleotide
  Target: AGXT; (-) strand; PAM type: YTN; PAM sequence: TTC
caatttaccagcacagaagg

SEQ ID NO: 13834 - DNA, 20 bp, Artificial Sequence
  Description of Artificial Sequence: Synthetic oligonucleotide
  Target: AGXT; (-) strand; PAM type: YTN; PAM sequence: TTT
ccaatttaccagcacagaag

SEQ ID NO: 13835 - DNA, 20 bp, Artificial Sequence
  Description of Artificial Sequence: Synthetic oligonucleotide
  Target: AGXT; (-) strand; PAM type: YTN; PAM sequence: TTG
taagtgtggatggtggggga

SEQ ID NO: 13836 - DNA, 20 bp, Artificial Sequence
  Description of Artificial Sequence: Synthetic oligonucleotide
  Target: AGXT; (-) strand; PAM type: YTN; PAM sequence: TTC
agtgatattgtaagtgtgga

SEQ ID NO: 13837 - DNA, 20 bp, Artificial Sequence
  Description of Artificial Sequence: Synthetic oligonucleotide
  Target: AGXT; (-) strand; PAM type: YTN; PAM sequence: TTT
cagtgatattgtaagtgtgg

SEQ ID NO: 13838 - DNA, 20 bp, Artificial Sequence
  Description of Artificial Sequence: Synthetic oligonucleotide
  Target: AGXT; (-) strand; PAM type: YTN; PAM sequence: TTA
aggaagtttcagtgatattg

SEQ ID NO: 13839 - DNA, 20 bp, Artificial Sequence
  Description of Artificial Sequence: Synthetic oligonucleotide
  Target: AGXT; (-) strand; PAM type: YTN; PAM sequence: TTA
caagttaaggaagtttcagt

SEQ ID NO: 13840 - DNA, 20 bp, Artificial Sequence
  Description of Artificial Sequence: Synthetic oligonucleotide
  Target: AGXT; (-) strand; PAM type: YTN; PAM sequence: CTC
ccaaaataacattacaagtt

SEQ ID NO: 13841 - DNA, 20 bp, Artificial Sequence
  Description of Artificial Sequence: Synthetic oligonucleotide
  Target: AGXT; (-) strand; PAM type: YTN; PAM sequence: TTA
taacaaggtgtacctcccaa

SEQ ID NO: 13842 - DNA, 20 bp, Artificial Sequence
  Description of Artificial Sequence: Synthetic oligonucleotide
  Target: AGXT; (-) strand; PAM type: YTN; PAM sequence: CTG
catgagtgtcattataacaa

SEQ ID NO: 13843 - DNA, 20 bp, Artificial Sequence
  Description of Artificial Sequence: Synthetic oligonucleotide
  Target: AGXT; (-) strand; PAM type: YTN; PAM sequence: TTA
gctgcatgagtgtcattata

SEQ ID NO: 13844 - DNA, 20 bp, Artificial Sequence
  Description of Artificial Sequence: Synthetic oligonucleotide
  Target: AGXT; (-) strand; PAM type: YTN; PAM sequence: CTC
aaatgagtcaaagttagctg

SEQ ID NO: 13845 - DNA, 20 bp, Artificial Sequence
  Description of Artificial Sequence: Synthetic oligonucleotide
  Target: AGXT; (-) strand; PAM type: YTN; PAM sequence: TTG
taggaggcgaaggcctcaaa

SEQ ID NO: 13846 - DNA, 20 bp, Artificial Sequence
  Description of Artificial Sequence: Synthetic oligonucleotide
  Target: AGXT; (-) strand; PAM type: YTN; PAM sequence: TTG
attgtaggaggcgaaggcct

SEQ ID NO: 13847 - DNA, 20 bp, Artificial Sequence
  Description of Artificial Sequence: Synthetic oligonucleotide
  Target: AGXT; (-) strand; PAM type: YTN; PAM sequence: TTT
gattgtaggaggcgaaggcc

SEQ ID NO: 13848 - DNA, 20 bp, Artificial Sequence
  Description of Artificial Sequence: Synthetic oligonucleotide
  Target: AGXT; (-) strand; PAM type: YTN; PAM sequence: TTT
tgattgtaggaggcgaaggc

SEQ ID NO: 13849 - DNA, 20 bp, Artificial Sequence
  Description of Artificial Sequence: Synthetic oligonucleotide
  Target: AGXT; (-) strand; PAM type: YTN; PAM sequence: CTG
gccagagtcagagttttgat

SEQ ID NO: 13850 - DNA, 20 bp, Artificial Sequence
  Description of Artificial Sequence: Synthetic oligonucleotide
  Target: AGXT; (-) strand; PAM type: YTN; PAM sequence: TTA
caggtgtgagccagcgcacc

SEQ ID NO: 13851 - DNA, 20 bp, Artificial Sequence
  Description of Artificial Sequence: Synthetic oligonucleotide
  Target: AGXT; (-) strand; PAM type: YTN; PAM sequence: TTA
ggattacaggtgtgagccag

SEQ ID NO: 13852 - DNA, 20 bp, Artificial Sequence
  Description of Artificial Sequence: Synthetic oligonucleotide
  Target: AGXT; (-) strand; PAM type: YTN; PAM sequence: CTC
ccaaagtgttaggattacag

SEQ ID NO: 13853 - DNA, 20 bp, Artificial Sequence
  Description of Artificial Sequence: Synthetic oligonucleotide
  Target: AGXT; (-) strand; PAM type: YTN; PAM sequence: CTA
cctcccaaagtgttaggatt

SEQ ID NO: 13854 - DNA, 20 bp, Artificial Sequence
  Description of Artificial Sequence: Synthetic oligonucleotide
  Target: AGXT; (-) strand; PAM type: YTN; PAM sequence: CTC
tacctcccaaagtgttagga

SEQ ID NO: 13855 - DNA, 20 bp, Artificial Sequence
  Description of Artificial Sequence: Synthetic oligonucleotide
  Target: AGXT; (-) strand; PAM type: YTN; PAM sequence: CTC
aggtgatccacccacctcta

SEQ ID NO: 13856 - DNA, 20 bp, Artificial Sequence
  Description of Artificial Sequence: Synthetic oligonucleotide
  Target: AGXT; (-) strand; PAM type: YTN; PAM sequence: CTG
acctcaggtgatccacccac

SEQ ID NO: 13857 - DNA, 20 bp, Artificial Sequence
  Description of Artificial Sequence: Synthetic oligonucleotide
  Target: AGXT; (-) strand; PAM type: YTN; PAM sequence: CTC
ctgacctcaggtgatccacc

SEQ ID NO: 13858 - DNA, 20 bp, Artificial Sequence
  Description of Artificial Sequence: Synthetic oligonucleotide
  Target: AGXT; (-) strand; PAM type: YTN; PAM sequence: CTC
gaactcctgacctcaggtga

SEQ ID NO: 13859 - DNA, 20 bp, Artificial Sequence
  Description of Artificial Sequence: Synthetic oligonucleotide
  Target: AGXT; (-) strand; PAM type: YTN; PAM sequence: CTG
gtctcgaactcctgacctca

SEQ ID NO: 13860 - DNA, 20 bp, Artificial Sequence
  Description of Artificial Sequence: Synthetic oligonucleotide
  Target: AGXT; (-) strand; PAM type: YTN; PAM sequence: TTG
gtcagactggtctcgaactc

SEQ ID NO: 13861 - DNA, 20 bp, Artificial Sequence
  Description of Artificial Sequence: Synthetic oligonucleotide
  Target: AGXT; (-) strand; PAM type: YTN; PAM sequence: TTC
accatgttggtcagactggt

SEQ ID NO: 13862 - DNA, 20 bp, Artificial Sequence
  Description of Artificial Sequence: Synthetic oligonucleotide
  Target: AGXT; (-) strand; PAM type: YTN; PAM sequence: TTT
caccatgttggtcagactgg

SEQ ID NO: 13863 - DNA, 20 bp, Artificial Sequence
  Description of Artificial Sequence: Synthetic oligonucleotide
  Target: AGXT; (-) strand; PAM type: YTN; PAM sequence: TTA
gtagagacagggtttcacca

SEQ ID NO: 13864 - DNA, 20 bp, Artificial Sequence
  Description of Artificial Sequence: Synthetic oligonucleotide
  Target: AGXT; (-) strand; PAM type: YTN; PAM sequence: TTT
agtagagacagggtttcacc

SEQ ID NO: 13865 - DNA, 20 bp, Artificial Sequence
  Description of Artificial Sequence: Synthetic oligonucleotide
  Target: AGXT; (-) strand; PAM type: YTN; PAM sequence: TTT
tagtagagacagggtttcac

SEQ ID NO: 13866 - DNA, 20 bp, Artificial Sequence
  Description of Artificial Sequence: Synthetic oligonucleotide
  Target: AGXT; (-) strand; PAM type: YTN; PAM sequence: TTT
ttagtagagacagggtttca

SEQ ID NO: 13867 - DNA, 20 bp, Artificial Sequence
  Description of Artificial Sequence: Synthetic oligonucleotide
  Target: AGXT; (-) strand; PAM type: YTN; PAM sequence: TTG
tatttttagtagagacaggg

SEQ ID NO: 13868 - DNA, 20 bp, Artificial Sequence
  Description of Artificial Sequence: Synthetic oligonucleotide
  Target: AGXT; (-) strand; PAM type: YTN; PAM sequence: TTT
gtatttttagtagagacagg

SEQ ID NO: 13869 - DNA, 20 bp, Artificial Sequence
  Description of Artificial Sequence: Synthetic oligonucleotide
  Target: AGXT; (-) strand; PAM type: YTN; PAM sequence: TTT
tgtatttttagtagagacag

SEQ ID NO: 13870 - DNA, 20 bp, Artificial Sequence
  Description of Artificial Sequence: Synthetic oligonucleotide
  Target: AGXT; (-) strand; PAM type: YTN; PAM sequence: TTT
ttgtatttttagtagagaca

SEQ ID NO: 13871 - DNA, 20 bp, Artificial Sequence
  Description of Artificial Sequence: Synthetic oligonucleotide
  Target: AGXT; (-) strand; PAM type: YTN; PAM sequence: CTA
atttttgtatttttagtaga

SEQ ID NO: 13872 - DNA, 20 bp, Artificial Sequence
  Description of Artificial Sequence: Synthetic oligonucleotide
  Target: AGXT; (-) strand; PAM type: YTN; PAM sequence: CTG
ctaatttttgtatttttagt

SEQ ID NO: 13873 - DNA, 20 bp, Artificial Sequence
  Description of Artificial Sequence: Synthetic oligonucleotide
  Target: AGXT; (-) strand; PAM type: YTN; PAM sequence: CTG
ccaccacgccctgctaattt

SEQ ID NO: 13874 - DNA, 20 bp, Artificial Sequence
  Description of Artificial Sequence: Synthetic oligonucleotide
  Target: AGXT; (-) strand; PAM type: YTN; PAM sequence: TTA
caggcacctgccaccacgcc

SEQ ID NO: 13875 - DNA, 20 bp, Artificial Sequence
  Description of Artificial Sequence: Synthetic oligonucleotide
  Target: AGXT; (-) strand; PAM type: YTN; PAM sequence: CTG
ggattacaggcacctgccac

SEQ ID NO: 13876 - DNA, 20 bp, Artificial Sequence
  Description of Artificial Sequence: Synthetic oligonucleotide
  Target: AGXT; (-) strand; PAM type: YTN; PAM sequence: CTG
agtagctgggattacaggca

SEQ ID NO: 13877 - DNA, 20 bp, Artificial Sequence
  Description of Artificial Sequence: Synthetic oligonucleotide
  Target: AGXT; (-) strand; PAM type: YTN; PAM sequence: CTC
ctgagtagctgggattacag

SEQ ID NO: 13878 - DNA, 20 bp, Artificial Sequence
  Description of Artificial Sequence: Synthetic oligonucleotide
  Target: AGXT; (-) strand; PAM type: YTN; PAM sequence: CTC
agcctcctgagtagctggga

SEQ ID NO: 13879 - DNA, 20 bp, Artificial Sequence
  Description of Artificial Sequence: Synthetic oligonucleotide
  Target: AGXT; (-) strand; PAM type: YTN; PAM sequence: CTG
cctcagcctcctgagtagct

SEQ ID NO: 13880 - DNA, 20 bp, Artificial Sequence
  Description of Artificial Sequence: Synthetic oligonucleotide
  Target: AGXT; (-) strand; PAM type: YTN; PAM sequence: CTC
ctgcctcagcctcctgagta

SEQ ID NO: 13881 - DNA, 20 bp, Artificial Sequence
  Description of Artificial Sequence: Synthetic oligonucleotide
  Target: AGXT; (-) strand; PAM type: YTN; PAM sequence: TTC
tcctgcctcagcctcctgag

SEQ ID NO: 13882 - DNA, 20 bp, Artificial Sequence
  Description of Artificial Sequence: Synthetic oligonucleotide
  Target: AGXT; (-) strand; PAM type: YTN; PAM sequence: TTC
aagcgattctcctgcctcag

SEQ ID NO: 13883 - DNA, 20 bp, Artificial Sequence
  Description of Artificial Sequence: Synthetic oligonucleotide
  Target: AGXT; (-) strand; PAM type: YTN; PAM sequence: CTG
ggttcaagcgattctcctgc

SEQ ID NO: 13884 - DNA, 20 bp, Artificial Sequence
  Description of Artificial Sequence: Synthetic oligonucleotide
  Target: AGXT; (-) strand; PAM type: YTN; PAM sequence: CTC
ctgggttcaagcgattctcc

SEQ ID NO: 13885 - DNA, 20 bp, Artificial Sequence
  Description of Artificial Sequence: Synthetic oligonucleotide
  Target: AGXT; (-) strand; PAM type: YTN; PAM sequence: CTG
ctcctgggttcaagcgattc

SEQ ID NO: 13886 - DNA, 20 bp, Artificial Sequence
  Description of Artificial Sequence: Synthetic oligonucleotide
  Target: AGXT; (-) strand; PAM type: YTN; PAM sequence: CTC
tgctcctgggttcaagcgat

SEQ ID NO: 13887 - DNA, 20 bp, Artificial Sequence
  Description of Artificial Sequence: Synthetic oligonucleotide
  Target: AGXT; (-) strand; PAM type: YTN; PAM sequence: CTG
caacctctgctcctgggttc

SEQ ID NO: 13888 - DNA, 20 bp, Artificial Sequence
  Description of Artificial Sequence: Synthetic oligonucleotide
  Target: AGXT; (-) strand; PAM type: YTN; PAM sequence: CTC
actgcaacctctgctcctgg

SEQ ID NO: 13889 - DNA, 20 bp, Artificial Sequence
  Description of Artificial Sequence: Synthetic oligonucleotide
  Target: AGXT; (-) strand; PAM type: YTN; PAM sequence: TTG
gctcactgcaacctctgctc

SEQ ID NO: 13890 - DNA, 20 bp, Artificial Sequence
  Description of Artificial Sequence: Synthetic oligonucleotide
  Target: AGXT; (-) strand; PAM type: YTN; PAM sequence: CTT
ggctcactgcaacctctgct

SEQ ID NO: 13891 - DNA, 20 bp, Artificial Sequence
  Description of Artificial Sequence: Synthetic oligonucleotide
  Target: AGXT; (-) strand; PAM type: YTN; PAM sequence: CTG
gagtgaagtggtgtgacctt

SEQ ID NO: 13892 - DNA, 20 bp, Artificial Sequence
  Description of Artificial Sequence: Synthetic oligonucleotide
  Target: AGXT; (-) strand; PAM type: YTN; PAM sequence: TTG
cccaggctggagtgaagtgg

SEQ ID NO: 13893 - DNA, 20 bp, Artificial Sequence
  Description of Artificial Sequence: Synthetic oligonucleotide
  Target: AGXT; (-) strand; PAM type: YTN; PAM sequence: CTC
agttgcccaggctggagtga

SEQ ID NO: 13894 - DNA, 20 bp, Artificial Sequence
  Description of Artificial Sequence: Synthetic oligonucleotide
  Target: AGXT; (-) strand; PAM type: YTN; PAM sequence: CTC
actcagttgcccaggctgga

SEQ ID NO: 13895 - DNA, 20 bp, Artificial Sequence
  Description of Artificial Sequence: Synthetic oligonucleotide
  Target: AGXT; (-) strand; PAM type: YTN; PAM sequence: TTG
agatggagtctcactcagtt

SEQ ID NO: 13896 - DNA, 20 bp, Artificial Sequence
  Description of Artificial Sequence: Synthetic oligonucleotide
  Target: AGXT; (-) strand; PAM type: YTN; PAM sequence: TTT
gagatggagtctcactcagt

SEQ ID NO: 13897 - DNA, 20 bp, Artificial Sequence
  Description of Artificial Sequence: Synthetic oligonucleotide
  Target: AGXT; (-) strand; PAM type: YTN; PAM sequence: TTT
tgagatggagtctcactcag

SEQ ID NO: 13898 - DNA, 20 bp, Artificial Sequence
  Description of Artificial Sequence: Synthetic oligonucleotide
  Target: AGXT; (-) strand; PAM type: YTN; PAM sequence: TTT
ttgagatggagtctcactca

SEQ ID NO: 13899 - DNA, 20 bp, Artificial Sequence
  Description of Artificial Sequence: Synthetic oligonucleotide
  Target: AGXT; (-) strand; PAM type: YTN; PAM sequence: TTT
tttgagatggagtctcactc

SEQ ID NO: 13900 - DNA, 20 bp, Artificial Sequence
  Description of Artificial Sequence: Synthetic oligonucleotide
  Target: AGXT; (-) strand; PAM type: YTN; PAM sequence: TTT
ttttgagatggagtctcact

SEQ ID NO: 13901 - DNA, 20 bp, Artificial Sequence
  Description of Artificial Sequence: Synthetic oligonucleotide
  Target: AGXT; (-) strand; PAM type: YTN; PAM sequence: TTT
tttttgagatggagtctcac

SEQ ID NO: 13902 - DNA, 20 bp, Artificial Sequence
  Description of Artificial Sequence: Synthetic oligonucleotide
  Target: AGXT; (-) strand; PAM type: YTN; PAM sequence: TTT
ttttttgagatggagtctca

SEQ ID NO: 13903 - DNA, 20 bp, Artificial Sequence
  Description of Artificial Sequence: Synthetic oligonucleotide
  Target: AGXT; (-) strand; PAM type: YTN; PAM sequence: TTT
tttttttgagatggagtctc

SEQ ID NO: 13904 - DNA, 20 bp, Artificial Sequence
  Description of Artificial Sequence: Synthetic oligonucleotide
  Target: AGXT; (-) strand; PAM type: YTN; PAM sequence: TTT
ttttttttgagatggagtct

SEQ ID NO: 13905 - DNA, 20 bp, Artificial Sequence
  Description of Artificial Sequence: Synthetic oligonucleotide
  Target: AGXT; (-) strand; PAM type: YTN; PAM sequence: TTT
tttttttttgagatggagtc

SEQ ID NO: 13906 - DNA, 20 bp, Artificial Sequence
  Description of Artificial Sequence: Synthetic oligonucleotide
  Target: AGXT; (-) strand; PAM type: YTN; PAM sequence: TTT
ttttttttttgagatggagt

SEQ ID NO: 13907 - DNA, 20 bp, Artificial Sequence
  Description of Artificial Sequence: Synthetic oligonucleotide
  Target: AGXT; (-) strand; PAM type: YTN; PAM sequence: TTT
tttttttttttgagatggag

SEQ ID NO: 13908 - DNA, 20 bp, Artificial Sequence
  Description of Artificial Sequence: Synthetic oligonucleotide
  Target: AGXT; (-) strand; PAM type: YTN; PAM sequence: TTT
ttttttttttttgagatgga

SEQ ID NO: 13909 - DNA, 20 bp, Artificial Sequence
  Description of Artificial Sequence: Synthetic oligonucleotide
  Target: AGXT; (-) strand; PAM type: YTN; PAM sequence: TTT
tttttttttttttgagatgg

SEQ ID NO: 13910 - DNA, 20 bp, Artificial Sequence
  Description of Artificial Sequence: Synthetic oligonucleotide
  Target: AGXT; (-) strand; PAM type: YTN; PAM sequence: TTT
ttttttttttttttgagatg

SEQ ID NO: 13911 - DNA, 20 bp, Artificial Sequence
  Description of Artificial Sequence: Synthetic oligonucleotide
  Target: AGXT; (-) strand; PAM type: YTN; PAM sequence: TTT
tttttttttttttttgagat

SEQ ID NO: 13912 - DNA, 20 bp, Artificial Sequence
  Description of Artificial Sequence: Synthetic oligonucleotide
  Target: AGXT; (-) strand; PAM type: YTN; PAM sequence: TTT
ttttttttttttttttgaga

SEQ ID NO: 13913 - DNA, 20 bp, Artificial Sequence
  Description of Artificial Sequence: Synthetic oligonucleotide
  Target: AGXT; (-) strand; PAM type: YTN; PAM sequence: TTT
tttttttttttttttttgag

SEQ ID NO: 13914 - DNA, 20 bp, Artificial Sequence
  Description of Artificial Sequence: Synthetic oligonucleotide
  Target: AGXT; (-) strand; PAM type: YTN; PAM sequence: TTG
gcagtgatgagatagagtca

SEQ ID NO: 13915 - DNA, 20 bp, Artificial Sequence
  Description of Artificial Sequence: Synthetic oligonucleotide
  Target: AGXT; (-) strand; PAM type: YTN; PAM sequence: TTA
taaattggcagtgatgagat

SEQ ID NO: 13916 - DNA, 20 bp, Artificial Sequence
  Description of Artificial Sequence: Synthetic oligonucleotide
  Target: AGXT; (-) strand; PAM type: YTN; PAM sequence: CTT
ataaattggcagtgatgaga

SEQ ID NO: 13917 - DNA, 20 bp, Artificial Sequence
  Description of Artificial Sequence: Synthetic oligonucleotide
  Target: AGXT; (-) strand; PAM type: YTN; PAM sequence: TTA
acggcttataaattggcagt

SEQ ID NO: 13918 - DNA, 20 bp, Artificial Sequence
  Description of Artificial Sequence: Synthetic oligonucleotide
  Target: AGXT; (-) strand; PAM type: YTN; PAM sequence: TTT
aacggcttataaattggcag

SEQ ID NO: 13919 - DNA, 20 bp, Artificial Sequence
  Description of Artificial Sequence: Synthetic oligonucleotide
  Target: AGXT; (-) strand; PAM type: YTN; PAM sequence: CTG
gtccagtttaacggcttata

SEQ ID NO: 13920 - DNA, 20 bp, Artificial Sequence
  Description of Artificial Sequence: Synthetic oligonucleotide
  Target: AGXT; (-) strand; PAM type: YTN; PAM sequence: CTA
tactggtccagtttaacggc

SEQ ID NO: 13921 - DNA, 20 bp, Artificial Sequence
  Description of Artificial Sequence: Synthetic oligonucleotide
  Target: AGXT; (-) strand; PAM type: YTN; PAM sequence: CTG
ggagccccactatactggtc

SEQ ID NO: 13922 - DNA, 20 bp, Artificial Sequence
  Description of Artificial Sequence: Synthetic oligonucleotide
  Target: AGXT; (-) strand; PAM type: YTN; PAM sequence: CTG
tatactgggagccccactat

SEQ ID NO: 13923 - DNA, 20 bp, Artificial Sequence
  Description of Artificial Sequence: Synthetic oligonucleotide
  Target: AGXT; (-) strand; PAM type: YTN; PAM sequence: TTA
ggagtgcaggggtgctgtat

SEQ ID NO: 13924 - DNA, 20 bp, Artificial Sequence
  Description of Artificial Sequence: Synthetic oligonucleotide
  Target: AGXT; (-) strand; PAM type: YTN; PAM sequence: TTA
tagtaacatacatgaaggta

SEQ ID NO: 13925 - DNA, 20 bp, Artificial Sequence
  Description of Artificial Sequence: Synthetic oligonucleotide
  Target: AGXT; (-) strand; PAM type: YTN; PAM sequence: TTG
catcattatagtaacataca

SEQ ID NO: 13926 - DNA, 20 bp, Artificial Sequence
  Description of Artificial Sequence: Synthetic oligonucleotide
  Target: AGXT; (-) strand; PAM type: YTN; PAM sequence: CTG
gttgcatcattatagtaaca

SEQ ID NO: 13927 - DNA, 20 bp, Artificial Sequence
  Description of Artificial Sequence: Synthetic oligonucleotide
  Target: AGXT; (-) strand; PAM type: YTN; PAM sequence: CTG
cactggttgcatcattatag

SEQ ID NO: 13928 - DNA, 20 bp, Artificial Sequence
  Description of Artificial Sequence: Synthetic oligonucleotide
  Target: AGXT; (-) strand; PAM type: YTN; PAM sequence: TTC
ctgcactggttgcatcatta

SEQ ID NO: 13929 - DNA, 20 bp, Artificial Sequence
  Description of Artificial Sequence: Synthetic oligonucleotide
  Target: AGXT; (-) strand; PAM type: YTN; PAM sequence: TTT
cctgcactggttgcatcatt

SEQ ID NO: 13930 - DNA, 20 bp, Artificial Sequence
  Description of Artificial Sequence: Synthetic oligonucleotide
  Target: AGXT; (-) strand; PAM type: YTN; PAM sequence: TTA
tttcctgcactggttgcatc

SEQ ID NO: 13931 - DNA, 20 bp, Artificial Sequence
  Description of Artificial Sequence: Synthetic oligonucleotide
  Target: AGXT; (-) strand; PAM type: YTN; PAM sequence: TTA
aaagcaggcgggtgccagtg

SEQ ID NO: 13932 - DNA, 20 bp, Artificial Sequence
  Description of Artificial Sequence: Synthetic oligonucleotide
  Target: AGXT; (-) strand; PAM type: YTN; PAM sequence: TTT
aaaagcaggcgggtgccagt

SEQ ID NO: 13933 - DNA, 20 bp, Artificial Sequence
  Description of Artificial Sequence: Synthetic oligonucleotide
  Target: AGXT; (-) strand; PAM type: YTN; PAM sequence: CTG
atggaggaggtttaaaagca

SEQ ID NO: 13934 - DNA, 20 bp, Artificial Sequence
  Description of Artificial Sequence: Synthetic oligonucleotide
  Target: AGXT; (-) strand; PAM type: YTN; PAM sequence: TTA
tgtactgatggaggaggttt

SEQ ID NO: 13935 - DNA, 20 bp, Artificial Sequence
  Description of Artificial Sequence: Synthetic oligonucleotide
  Target: AGXT; (-) strand; PAM type: YTN; PAM sequence: TTT
atgtactgatggaggaggtt

SEQ ID NO: 13936 - DNA, 20 bp, Artificial Sequence
  Description of Artificial Sequence: Synthetic oligonucleotide
  Target: AGXT; (-) strand; PAM type: YTN; PAM sequence: CTA
tgtttatgtactgatggagg

SEQ ID NO: 13937 - DNA, 20 bp, Artificial Sequence
  Description of Artificial Sequence: Synthetic oligonucleotide
  Target: AGXT; (-) strand; PAM type: YTN; PAM sequence: CTC
atatgggggaaagactatgt

SEQ ID NO: 13938 - DNA, 20 bp, Artificial Sequence
  Description of Artificial Sequence: Synthetic oligonucleotide
  Target: AGXT; (-) strand; PAM type: YTN; PAM sequence: TTA
agaggactcatatgggggaa

SEQ ID NO: 13939 - DNA, 20 bp, Artificial Sequence
  Description of Artificial Sequence: Synthetic oligonucleotide
  Target: AGXT; (-) strand; PAM type: YTN; PAM sequence: TTT
aagaggactcatatggggga

SEQ ID NO: 13940 - DNA, 20 bp, Artificial Sequence
  Description of Artificial Sequence: Synthetic oligonucleotide
  Target: AGXT; (-) strand; PAM type: YTN; PAM sequence: TTT
taagaggactcatatggggg

SEQ ID NO: 13941 - DNA, 20 bp, Artificial Sequence
  Description of Artificial Sequence: Synthetic oligonucleotide
  Target: AGXT; (-) strand; PAM type: YTN; PAM sequence: TTG
acagttttaagaggactcat

SEQ ID NO: 13942 - DNA, 20 bp, Artificial Sequence
  Description of Artificial Sequence: Synthetic oligonucleotide
  Target: AGXT; (-) strand; PAM type: YTN; PAM sequence: TTT
gacagttttaagaggactca

SEQ ID NO: 13943 - DNA, 20 bp, Artificial Sequence
  Description of Artificial Sequence: Synthetic oligonucleotide
  Target: AGXT; (-) strand; PAM type: YTN; PAM sequence: TTT
tgacagttttaagaggactc

SEQ ID NO: 13944 - DNA, 20 bp, Artificial Sequence
  Description of Artificial Sequence: Synthetic oligonucleotide
  Target: AGXT; (-) strand; PAM type: YTN; PAM sequence: CTT
ttgacagttttaagaggact

SEQ ID NO: 13945 - DNA, 20 bp, Artificial Sequence
  Description of Artificial Sequence: Synthetic oligonucleotide
  Target: AGXT; (-) strand; PAM type: YTN; PAM sequence: TTG
ggaaaaaaggaaatgggcct

SEQ ID NO: 13946 - DNA, 20 bp, Artificial Sequence
  Description of Artificial Sequence: Synthetic oligonucleotide
  Target: AGXT; (-) strand; PAM type: YTN; PAM sequence: TTA
aaatgttgggaaaaaaggaa

SEQ ID NO: 13947 - DNA, 20 bp, Artificial Sequence
  Description of Artificial Sequence: Synthetic oligonucleotide
  Target: AGXT; (-) strand; PAM type: YTN; PAM sequence: TTA
attaaaatgttgggaaaaaa

SEQ ID NO: 13948 - DNA, 20 bp, Artificial Sequence
  Description of Artificial Sequence: Synthetic oligonucleotide
  Target: AGXT; (-) strand; PAM type: YTN; PAM sequence: TTT
aattaaaatgttgggaaaaa

SEQ ID NO: 13949 - DNA, 20 bp, Artificial Sequence
  Description of Artificial Sequence: Synthetic oligonucleotide
  Target: AGXT; (-) strand; PAM type: YTN; PAM sequence: TTT
taattaaaatgttgggaaaa

SEQ ID NO: 13950 - DNA, 20 bp, Artificial Sequence
  Description of Artificial Sequence: Synthetic oligonucleotide
  Target: AGXT; (-) strand; PAM type: YTN; PAM sequence: TTA
ttttaattaaaatgttggga

SEQ ID NO: 13951 - DNA, 20 bp, Artificial Sequence
  Description of Artificial Sequence: Synthetic oligonucleotide
  Target: AGXT; (-) strand; PAM type: YTN; PAM sequence: CTA
agccataagagcccaggagg

SEQ ID NO: 13952 - DNA, 20 bp, Artificial Sequence
  Description of Artificial Sequence: Synthetic oligonucleotide
  Target: AGXT; (-) strand; PAM type: YTN; PAM sequence: CTG
ctaagccataagagcccagg

SEQ ID NO: 13953 - DNA, 20 bp, Artificial Sequence
  Description of Artificial Sequence: Synthetic oligonucleotide
  Target: AGXT; (-) strand; PAM type: YTN; PAM sequence: TTA
gtggggctgctaagccataa

SEQ ID NO: 13954 - DNA, 20 bp, Artificial Sequence
  Description of Artificial Sequence: Synthetic oligonucleotide
  Target: AGXT; (-) strand; PAM type: YTN; PAM sequence: TTT
agtggggctgctaagccata

SEQ ID NO: 13955 - DNA, 20 bp, Artificial Sequence
  Description of Artificial Sequence: Synthetic oligonucleotide
  Target: AGXT; (-) strand; PAM type: YTN; PAM sequence: TTT
tagtggggctgctaagccat

SEQ ID NO: 13956 - DNA, 20 bp, Artificial Sequence
  Description of Artificial Sequence: Synthetic oligonucleotide
  Target: AGXT; (-) strand; PAM type: YTN; PAM sequence: TTT
ttagtggggctgctaagcca

SEQ ID NO: 13957 - DNA, 20 bp, Artificial Sequence
  Description of Artificial Sequence: Synthetic oligonucleotide
  Target: AGXT; (-) strand; PAM type: YTN; PAM sequence: TTA
aatagtttttagtggggctg

SEQ ID NO: 13958 - DNA, 20 bp, Artificial Sequence
  Description of Artificial Sequence: Synthetic oligonucleotide
  Target: AGXT; (-) strand; PAM type: YTN; PAM sequence: TTT
aaatagtttttagtggggct

SEQ ID NO: 13959 - DNA, 20 bp, Artificial Sequence
  Description of Artificial Sequence: Synthetic oligonucleotide
  Target: AGXT; (-) strand; PAM type: YTN; PAM sequence: TTG
aaaagggtttaaatagtttt

SEQ ID NO: 13960 - DNA, 20 bp, Artificial Sequence
  Description of Artificial Sequence: Synthetic oligonucleotide
  Target: AGXT; (-) strand; PAM type: YTN; PAM sequence: CTT
gaaaagggtttaaatagttt

SEQ ID NO: 13961 - DNA, 20 bp, Artificial Sequence
  Description of Artificial Sequence: Synthetic oligonucleotide
  Target: AGXT; (-) strand; PAM type: YTN; PAM sequence: CTA
caatcaccatagtgaagaga

SEQ ID NO: 13962 - DNA, 20 bp, Artificial Sequence
  Description of Artificial Sequence: Synthetic oligonucleotide
  Target: AGXT; (-) strand; PAM type: YTN; PAM sequence: TTC
ccaggctacaatcaccatag

SEQ ID NO: 13963 - DNA, 20 bp, Artificial Sequence
  Description of Artificial Sequence: Synthetic oligonucleotide
  Target: AGXT; (-) strand; PAM type: YTN; PAM sequence: TTG
ttcccaggctacaatcacca

SEQ ID NO: 13964 - DNA, 20 bp, Artificial Sequence
  Description of Artificial Sequence: Synthetic oligonucleotide
  Target: AGXT; (-) strand; PAM type: YTN; PAM sequence: CTA
ttgttcccaggctacaatca

SEQ ID NO: 13965 - DNA, 20 bp, Artificial Sequence
  Description of Artificial Sequence: Synthetic oligonucleotide
  Target: AGXT; (-) strand; PAM type: YTN; PAM sequence: TTG
ggtgggagctattgttccca

SEQ ID NO: 13966 - DNA, 20 bp, Artificial Sequence
  Description of Artificial Sequence: Synthetic oligonucleotide
  Target: AGXT; (-) strand; PAM type: YTN; PAM sequence: TTT
gggtgggagctattgttccc

SEQ ID NO: 13967 - DNA, 20 bp, Artificial Sequence
  Description of Artificial Sequence: Synthetic oligonucleotide
  Target: AGXT; (-) strand; PAM type: YTN; PAM sequence: TTA
agacagtgatttgggtggga

SEQ ID NO: 13968 - DNA, 20 bp, Artificial Sequence
  Description of Artificial Sequence: Synthetic oligonucleotide
  Target: AGXT; (-) strand; PAM type: YTN; PAM sequence: TTT
aagacagtgatttgggtggg

SEQ ID NO: 13969 - DNA, 20 bp, Artificial Sequence
  Description of Artificial Sequence: Synthetic oligonucleotide
  Target: AGXT; (-) strand; PAM type: YTN; PAM sequence: TTA
gaagtgatgtttaagacagt

SEQ ID NO: 13970 - DNA, 20 bp, Artificial Sequence
  Description of Artificial Sequence: Synthetic oligonucleotide
  Target: AGXT; (-) strand; PAM type: YTN; PAM sequence: CTG
aattagaagtgatgtttaag

SEQ ID NO: 13971 - DNA, 20 bp, Artificial Sequence
  Description of Artificial Sequence: Synthetic oligonucleotide
  Target: AGXT; (-) strand; PAM type: YTN; PAM sequence: TTC
tgaattagaagtgatgttta

SEQ ID NO: 13972 - DNA, 20 bp, Artificial Sequence
  Description of Artificial Sequence: Synthetic oligonucleotide
  Target: AGXT; (-) strand; PAM type: YTN; PAM sequence: CTA
gaagggaattctgaattaga

SEQ ID NO: 13973 - DNA, 20 bp, Artificial Sequence
  Description of Artificial Sequence: Synthetic oligonucleotide
  Target: AGXT; (-) strand; PAM type: YTN; PAM sequence: TTC
tagaagggaattctgaatta

SEQ ID NO: 13974 - DNA, 20 bp, Artificial Sequence
  Description of Artificial Sequence: Synthetic oligonucleotide
  Target: AGXT; (-) strand; PAM type: YTN; PAM sequence: CTT
ctagaagggaattctgaatt

SEQ ID NO: 13975 - DNA, 20 bp, Artificial Sequence
  Description of Artificial Sequence: Synthetic oligonucleotide
  Target: AGXT; (-) strand; PAM type: YTN; PAM sequence: TTC
cttctagaagggaattctga

SEQ ID NO: 13976 - DNA, 20 bp, Artificial Sequence
  Description of Artificial Sequence: Synthetic oligonucleotide
  Target: AGXT; (-) strand; PAM type: YTN; PAM sequence: TTT
ccttctagaagggaattctg

SEQ ID NO: 13977 - DNA, 20 bp, Artificial Sequence
  Description of Artificial Sequence: Synthetic oligonucleotide
  Target: AGXT; (-) strand; PAM type: YTN; PAM sequence: TTT
tccttctagaagggaattct

SEQ ID NO: 13978 - DNA, 20 bp, Artificial Sequence
  Description of Artificial Sequence: Synthetic oligonucleotide
  Target: AGXT; (-) strand; PAM type: YTN; PAM sequence: CTT
ttccttctagaagggaattc

SEQ ID NO: 13979 - DNA, 20 bp, Artificial Sequence
  Description of Artificial Sequence: Synthetic oligonucleotide
  Target: AGXT; (-) strand; PAM type: YTN; PAM sequence: CTC
cggccacagtaagtcccagg

SEQ ID NO: 13980 - DNA, 20 bp, Artificial Sequence
  Description of Artificial Sequence: Synthetic oligonucleotide
  Target: AGXT; (-) strand; PAM type: YTN; PAM sequence: TTC
ccacaactccggccacagta

SEQ ID NO: 13981 - DNA, 20 bp, Artificial Sequence
  Description of Artificial Sequence: Synthetic oligonucleotide
  Target: AGXT; (-) strand; PAM type: YTN; PAM sequence: TTG
tgatagttcccacaactccg

SEQ ID NO: 13982 - DNA, 20 bp, Artificial Sequence
  Description of Artificial Sequence: Synthetic oligonucleotide
  Target: AGXT; (-) strand; PAM type: YTN; PAM sequence: CTC
cccaaggggtaagagttgtg

SEQ ID NO: 13983 - DNA, 20 bp, Artificial Sequence
  Description of Artificial Sequence: Synthetic oligonucleotide
  Target: AGXT; (-) strand; PAM type: YTN; PAM sequence: CTG
gtaagtaaaacctccccaag

SEQ ID NO: 13984 - DNA, 20 bp, Artificial Sequence
  Description of Artificial Sequence: Synthetic oligonucleotide
  Target: AGXT; (-) strand; PAM type: YTN; PAM sequence: TTC
ctggtaagtaaaacctcccc

SEQ ID NO: 13985 - DNA, 20 bp, Artificial Sequence
  Description of Artificial Sequence: Synthetic oligonucleotide
  Target: AGXT; (-) strand; PAM type: YTN; PAM sequence: TTT
cctggtaagtaaaacctccc

SEQ ID NO: 13986 - DNA, 20 bp, Artificial Sequence
  Description of Artificial Sequence: Synthetic oligonucleotide
  Target: AGXT; (-) strand; PAM type: YTN; PAM sequence: TTG
tgatttcctggtaagtaaaa

SEQ ID NO: 13987 - DNA, 20 bp, Artificial Sequence
  Description of Artificial Sequence: Synthetic oligonucleotide
  Target: AGXT; (-) strand; PAM type: YTN; PAM sequence: CTT
gtgatttcctggtaagtaaa

SEQ ID NO: 13988 - DNA, 20 bp, Artificial Sequence
  Description of Artificial Sequence: Synthetic oligonucleotide
  Target: AGXT; (-) strand; PAM type: YTN; PAM sequence: TTA
cttgtgatttcctggtaagt

SEQ ID NO: 13989 - DNA, 20 bp, Artificial Sequence
  Description of Artificial Sequence: Synthetic oligonucleotide
  Target: AGXT; (-) strand; PAM type: YTN; PAM sequence: CTT
acttgtgatttcctggtaag

SEQ ID NO: 13990 - DNA, 20 bp, Artificial Sequence
  Description of Artificial Sequence: Synthetic oligonucleotide
  Target: AGXT; (-) strand; PAM type: YTN; PAM sequence: CTC
ttacttgtgatttcctggta

SEQ ID NO: 13991 - DNA, 20 bp, Artificial Sequence
  Description of Artificial Sequence: Synthetic oligonucleotide
  Target: AGXT; (-) strand; PAM type: YTN; PAM sequence: TTC
tcttacttgtgatttcctgg

SEQ ID NO: 13992 - DNA, 20 bp, Artificial Sequence
  Description of Artificial Sequence: Synthetic oligonucleotide
  Target: AGXT; (-) strand; PAM type: YTN; PAM sequence: TTC
aagggaggcggtaggttctc

SEQ ID NO: 13993 - DNA, 20 bp, Artificial Sequence
  Description of Artificial Sequence: Synthetic oligonucleotide
  Target: AGXT; (-) strand; PAM type: YTN; PAM sequence: TTT
caagggaggcggtaggttct

SEQ ID NO: 13994 - DNA, 20 bp, Artificial Sequence
  Description of Artificial Sequence: Synthetic oligonucleotide
  Target: AGXT; (-) strand; PAM type: YTN; PAM sequence: CTA
tttcaagggaggcggtaggt

SEQ ID NO: 13995 - DNA, 20 bp, Artificial Sequence
  Description of Artificial Sequence: Synthetic oligonucleotide
  Target: AGXT; (-) strand; PAM type: YTN; PAM sequence: TTG
ctatttcaagggaggcggta

SEQ ID NO: 13996 - DNA, 20 bp, Artificial Sequence
  Description of Artificial Sequence: Synthetic oligonucleotide
  Target: AGXT; (-) strand; PAM type: YTN; PAM sequence: TTT
gctatttcaagggaggcggt

SEQ ID NO: 13997 - DNA, 20 bp, Artificial Sequence
  Description of Artificial Sequence: Synthetic oligonucleotide
  Target: AGXT; (-) strand; PAM type: YTN; PAM sequence: TTT
tgctatttcaagggaggcgg

SEQ ID NO: 13998 - DNA, 20 bp, Artificial Sequence
  Description of Artificial Sequence: Synthetic oligonucleotide
  Target: AGXT; (-) strand; PAM type: YTN; PAM sequence: CTT
ttgctatttcaagggaggcg

SEQ ID NO: 13999 - DNA, 20 bp, Artificial Sequence
  Description of Artificial Sequence: Synthetic oligonucleotide
  Target: AGXT; (-) strand; PAM type: YTN; PAM sequence: CTG
atagatgggtgccagctttt

SEQ ID NO: 14000 - DNA, 20 bp, Artificial Sequence
  Description of Artificial Sequence: Synthetic oligonucleotide
  Target: AGXT; (-) strand; PAM type: YTN; PAM sequence: TTG
tagagctgatagatgggtgc

SEQ ID NO: 14001 - DNA, 20 bp, Artificial Sequence
  Description of Artificial Sequence: Synthetic oligonucleotide
  Target: AGXT; (-) strand; PAM type: YTN; PAM sequence: CTT
gtagagctgatagatgggtg

SEQ ID NO: 14002 - DNA, 20 bp, Artificial Sequence
  Description of Artificial Sequence: Synthetic oligonucleotide
  Target: AGXT; (-) strand; PAM type: YTN; PAM sequence: CTA
atgacttgtagagctgatag

SEQ ID NO: 14003 - DNA, 20 bp, Artificial Sequence
  Description of Artificial Sequence: Synthetic oligonucleotide
  Target: AGXT; (-) strand; PAM type: YTN; PAM sequence: TTG
tgagtctaatgacttgtaga

SEQ ID NO: 14004 - DNA, 20 bp, Artificial Sequence
  Description of Artificial Sequence: Synthetic oligonucleotide
  Target: AGXT; (-) strand; PAM type: YTN; PAM sequence: CTT
gtgagtctaatgacttgtag

SEQ ID NO: 14005 - DNA, 20 bp, Artificial Sequence
  Description of Artificial Sequence: Synthetic oligonucleotide
  Target: AGXT; (-) strand; PAM type: YTN; PAM sequence: CTG
cttgtgagtctaatgacttg

SEQ ID NO: 14006 - DNA, 20 bp, Artificial Sequence
  Description of Artificial Sequence: Synthetic oligonucleotide
  Target: AGXT; (-) strand; PAM type: YTN; PAM sequence: TTA
ccagacaccaaaatcctgct

SEQ ID NO: 14007 - DNA, 20 bp, Artificial Sequence
  Description of Artificial Sequence: Synthetic oligonucleotide
  Target: AGXT; (-) strand; PAM type: YTN; PAM sequence: CTG
ttaccagacaccaaaatcct

SEQ ID NO: 14008 - DNA, 20 bp, Artificial Sequence
  Description of Artificial Sequence: Synthetic oligonucleotide
  Target: AGXT; (-) strand; PAM type: YTN; PAM sequence: CTC
acctgttaccagacaccaaa

SEQ ID NO: 14009 - DNA, 20 bp, Artificial Sequence
  Description of Artificial Sequence: Synthetic oligonucleotide
  Target: AGXT; (-) strand; PAM type: YTN; PAM sequence: CTA
ggaggtaatccagaactcac

SEQ ID NO: 14010 - DNA, 20 bp, Artificial Sequence
  Description of Artificial Sequence: Synthetic oligonucleotide
  Target: AGXT; (-) strand; PAM type: YTN; PAM sequence: TTC
agctaggaggtaatccagaa

SEQ ID NO: 14011 - DNA, 20 bp, Artificial Sequence
  Description of Artificial Sequence: Synthetic oligonucleotide
  Target: AGXT; (-) strand; PAM type: YTN; PAM sequence: TTG
ttcagctaggaggtaatcca

SEQ ID NO: 14012 - DNA, 20 bp, Artificial Sequence
  Description of Artificial Sequence: Synthetic oligonucleotide
  Target: AGXT; (-) strand; PAM type: YTN; PAM sequence: CTT
gttcagctaggaggtaatcc

SEQ ID NO: 14013 - DNA, 20 bp, Artificial Sequence
  Description of Artificial Sequence: Synthetic oligonucleotide
  Target: AGXT; (-) strand; PAM type: YTN; PAM sequence: CTC
cttgttcagctaggaggtaa

SEQ ID NO: 14014 - DNA, 20 bp, Artificial Sequence
  Description of Artificial Sequence: Synthetic oligonucleotide
  Target: AGXT; (-) strand; PAM type: YTN; PAM sequence: TTG
atgacagcacagacccctcc

SEQ ID NO: 14015 - DNA, 20 bp, Artificial Sequence
  Description of Artificial Sequence: Synthetic oligonucleotide
  Target: AGXT; (-) strand; PAM type: YTN; PAM sequence: CTG
ttgatgacagcacagacccc

SEQ ID NO: 14016 - DNA, 20 bp, Artificial Sequence
  Description of Artificial Sequence: Synthetic oligonucleotide
  Target: AGXT; (-) strand; PAM type: YTN; PAM sequence: CTC
cagacacataaatgtaggtg

SEQ ID NO: 14017 - DNA, 20 bp, Artificial Sequence
  Description of Artificial Sequence: Synthetic oligonucleotide
  Target: AGXT; (-) strand; PAM type: YTN; PAM sequence: TTC
tccagacacataaatgtagg

SEQ ID NO: 14018 - DNA, 20 bp, Artificial Sequence
  Description of Artificial Sequence: Synthetic oligonucleotide
  Target: AGXT; (-) strand; PAM type: YTN; PAM sequence: CTT
ctccagacacataaatgtag

SEQ ID NO: 14019 - DNA, 20 bp, Artificial Sequence
  Description of Artificial Sequence: Synthetic oligonucleotide
  Target: AGXT; (-) strand; PAM type: YTN; PAM sequence: TTC
cacttctccagacacataaa

SEQ ID NO: 14020 - DNA, 20 bp, Artificial Sequence
  Description of Artificial Sequence: Synthetic oligonucleotide
  Target: AGXT; (-) strand; PAM type: YTN; PAM sequence: TTT
ccacttctccagacacataa

SEQ ID NO: 14021 - DNA, 20 bp, Artificial Sequence
  Description of Artificial Sequence: Synthetic oligonucleotide
  Target: AGXT; (-) strand; PAM type: YTN; PAM sequence: TTG
ggcatcggtttccacttctc

SEQ ID NO: 14022 - DNA, 20 bp, Artificial Sequence
  Description of Artificial Sequence: Synthetic oligonucleotide
  Target: AGXT; (-) strand; PAM type: YTN; PAM sequence: CTT
gggcatcggtttccacttct

SEQ ID NO: 14023 - DNA, 20 bp, Artificial Sequence
  Description of Artificial Sequence: Synthetic oligonucleotide
  Target: AGXT; (-) strand; PAM type: YTN; PAM sequence: TTC
ttgggcatcggtttccactt

SEQ ID NO: 14024 - DNA, 20 bp, Artificial Sequence
  Description of Artificial Sequence: Synthetic oligonucleotide
  Target: AGXT; (-) strand; PAM type: YTN; PAM sequence: TTT
cttgggcatcggtttccact

SEQ ID NO: 14025 - DNA, 20 bp, Artificial Sequence
  Description of Artificial Sequence: Synthetic oligonucleotide
  Target: AGXT; (-) strand; PAM type: YTN; PAM sequence: TTG
atgatttcttgggcatcggt

SEQ ID NO: 14026 - DNA, 20 bp, Artificial Sequence
  Description of Artificial Sequence: Synthetic oligonucleotide
  Target: AGXT; (-) strand; PAM type: YTN; PAM sequence: TTT
gatgatttcttgggcatcgg

SEQ ID NO: 14027 - DNA, 20 bp, Artificial Sequence
  Description of Artificial Sequence: Synthetic oligonucleotide
  Target: AGXT; (-) strand; PAM type: YTN; PAM sequence: TTG
tttgatgatttcttgggcat

SEQ ID NO: 14028 - DNA, 20 bp, Artificial Sequence
  Description of Artificial Sequence: Synthetic oligonucleotide
  Target: AGXT; (-) strand; PAM type: YTN; PAM sequence: CTT
gtttgatgatttcttgggca

SEQ ID NO: 14029 - DNA, 20 bp, Artificial Sequence
  Description of Artificial Sequence: Synthetic oligonucleotide
  Target: AGXT; (-) strand; PAM type: YTN; PAM sequence: TTG
gcttgtttgatgatttcttg

SEQ ID NO: 14030 - DNA, 20 bp, Artificial Sequence
  Description of Artificial Sequence: Synthetic oligonucleotide
  Target: AGXT; (-) strand; PAM type: YTN; PAM sequence: TTT
ggcttgtttgatgatttctt

SEQ ID NO: 14031 - DNA, 20 bp, Artificial Sequence
  Description of Artificial Sequence: Synthetic oligonucleotide
  Target: AGXT; (-) strand; PAM type: YTN; PAM sequence: TTG
ggaaagtgtgtgtagccatt

SEQ ID NO: 14032 - DNA, 20 bp, Artificial Sequence
  Description of Artificial Sequence: Synthetic oligonucleotide
  Target: AGXT; (-) strand; PAM type: YTN; PAM sequence: TTT
gggaaagtgtgtgtagccat

SEQ ID NO: 14033 - DNA, 20 bp, Artificial Sequence
  Description of Artificial Sequence: Synthetic oligonucleotide
  Target: AGXT; (-) strand; PAM type: YTN; PAM sequence: CTT
tgggaaagtgtgtgtagcca

SEQ ID NO: 14034 - DNA, 20 bp, Artificial Sequence
  Description of Artificial Sequence: Synthetic oligonucleotide
  Target: AGXT; (-) strand; PAM type: YTN; PAM sequence: TTG
ctttgggaaagtgtgtgtag

SEQ ID NO: 14035 - DNA, 20 bp, Artificial Sequence
  Description of Artificial Sequence: Synthetic oligonucleotide
  Target: AGXT; (-) strand; PAM type: YTN; PAM sequence: TTG
gttgctttgggaaagtgtgt

SEQ ID NO: 14036 - DNA, 20 bp, Artificial Sequence
  Description of Artificial Sequence: Synthetic oligonucleotide
  Target: AGXT; (-) strand; PAM type: YTN; PAM sequence: CTT
ggttgctttgggaaagtgtg

SEQ ID NO: 14037 - DNA, 20 bp, Artificial Sequence
  Description of Artificial Sequence: Synthetic oligonucleotide
  Target: AGXT; (-) strand; PAM type: YTN; PAM sequence: TTG
gcccagtcttggttgctttg

SEQ ID NO: 14038 - DNA, 20 bp, Artificial Sequence
  Description of Artificial Sequence: Synthetic oligonucleotide
  Target: AGXT; (-) strand; PAM type: YTN; PAM sequence: TTT
ggcccagtcttggttgcttt

SEQ ID NO: 14039 - DNA, 20 bp, Artificial Sequence
  Description of Artificial Sequence: Synthetic oligonucleotide
  Target: AGXT; (-) strand; PAM type: YTN; PAM sequence: TTT
tggcccagtcttggttgctt

SEQ ID NO: 14040 - DNA, 20 bp, Artificial Sequence
  Description of Artificial Sequence: Synthetic oligonucleotide
  Target: AGXT; (-) strand; PAM type: YTN; PAM sequence: TTG
aaaaccaatcagtaaaagtt

SEQ ID NO: 14041 - DNA, 20 bp, Artificial Sequence
  Description of Artificial Sequence: Synthetic oligonucleotide
  Target: AGXT; (-) strand; PAM type: YTN; PAM sequence: TTT
gaaaaccaatcagtaaaagt

SEQ ID NO: 14042 - DNA, 20 bp, Artificial Sequence
  Description of Artificial Sequence: Synthetic oligonucleotide
  Target: AGXT; (-) strand; PAM type: YTN; PAM sequence: TTT
tgaaaaccaatcagtaaaag

SEQ ID NO: 14043 - DNA, 20 bp, Artificial Sequence
  Description of Artificial Sequence: Synthetic oligonucleotide
  Target: AGXT; (-) strand; PAM type: YTN; PAM sequence: TTT
ttgaaaaccaatcagtaaaa

SEQ ID NO: 14044 - DNA, 20 bp, Artificial Sequence
  Description of Artificial Sequence: Synthetic oligonucleotide
  Target: AGXT; (-) strand; PAM type: YTN; PAM sequence: TTT
tttgaaaaccaatcagtaaa

SEQ ID NO: 14045 - DNA, 20 bp, Artificial Sequence
  Description of Artificial Sequence: Synthetic oligonucleotide
  Target: AGXT; (-) strand; PAM type: YTN; PAM sequence: CTA
aggaatgggggaagccaagt

SEQ ID NO: 14046 - DNA, 20 bp, Artificial Sequence
  Description of Artificial Sequence: Synthetic oligonucleotide
  Target: AGXT; (-) strand; PAM type: YTN; PAM sequence: TTA
aaagaaaaatgacagaagat

SEQ ID NO: 14047 - DNA, 20 bp, Artificial Sequence
  Description of Artificial Sequence: Synthetic oligonucleotide
  Target: AGXT; (-) strand; PAM type: YTN; PAM sequence: TTA
aaaaggcagggaccaaatat

SEQ ID NO: 14048 - DNA, 20 bp, Artificial Sequence
  Description of Artificial Sequence: Synthetic oligonucleotide
  Target: AGXT; (-) strand; PAM type: YTN; PAM sequence: CTC
atgtagaacatagaaaagca

SEQ ID NO: 14049 - DNA, 20 bp, Artificial Sequence
  Description of Artificial Sequence: Synthetic oligonucleotide
  Target: AGXT; (-) strand; PAM type: YTN; PAM sequence: TTC
tcatgtagaacatagaaaag

SEQ ID NO: 14050 - DNA, 20 bp, Artificial Sequence
  Description of Artificial Sequence: Synthetic oligonucleotide
  Target: AGXT; (-) strand; PAM type: YTN; PAM sequence: TTG
ttctcatgtagaacatagaa

SEQ ID NO: 14051 - DNA, 20 bp, Artificial Sequence
  Description of Artificial Sequence: Synthetic oligonucleotide
  Target: AGXT; (-) strand; PAM type: YTN; PAM sequence: CTG
caggtggaattgttctcatg

SEQ ID NO: 14052 - DNA, 20 bp, Artificial Sequence
  Description of Artificial Sequence: Synthetic oligonucleotide
  Target: AGXT; (-) strand; PAM type: YTN; PAM sequence: TTC
tgcaggtggaattgttctca

SEQ ID NO: 14053 - DNA, 20 bp, Artificial Sequence
  Description of Artificial Sequence: Synthetic oligonucleotide
  Target: AGXT; (-) strand; PAM type: YTN; PAM sequence: CTT
ctgcaggtggaattgttctc

SEQ ID NO: 14054 - DNA, 20 bp, Artificial Sequence
  Description of Artificial Sequence: Synthetic oligonucleotide
  Target: AGXT; (-) strand; PAM type: YTN; PAM sequence: TTG
ggaatgcatagccttctgca

SEQ ID NO: 14055 - DNA, 20 bp, Artificial Sequence
  Description of Artificial Sequence: Synthetic oligonucleotide
  Target: AGXT; (-) strand; PAM type: YTN; PAM sequence: TTG
caggccagtgttgggaatgc

SEQ ID NO: 14056 - DNA, 20 bp, Artificial Sequence
  Description of Artificial Sequence: Synthetic oligonucleotide
  Target: AGXT; (-) strand; PAM type: YTN; PAM sequence: CTG
cagttgcaggccagtgttgg

SEQ ID NO: 14057 - DNA, 20 bp, Artificial Sequence
  Description of Artificial Sequence: Synthetic oligonucleotide
  Target: AGXT; (-) strand; PAM type: YTN; PAM sequence: TTC
catcaagaagccccatgtaa

SEQ ID NO: 14058 - DNA, 20 bp, Artificial Sequence
  Description of Artificial Sequence: Synthetic oligonucleotide
  Target: AGXT; (-) strand; PAM type: YTN; PAM sequence: TTT
ccatcaagaagccccatgta

SEQ ID NO: 14059 - DNA, 20 bp, Artificial Sequence
  Description of Artificial Sequence: Synthetic oligonucleotide
  Target: AGXT; (-) strand; PAM type: YTN; PAM sequence: TTG
caggccggtatttccatcaa

SEQ ID NO: 14060 - DNA, 20 bp, Artificial Sequence
  Description of Artificial Sequence: Synthetic oligonucleotide
  Target: AGXT; (-) strand; PAM type: YTN; PAM sequence: CTG
cagttgcaggccggtatttc

SEQ ID NO: 14061 - DNA, 20 bp, Artificial Sequence
  Description of Artificial Sequence: Synthetic oligonucleotide
  Target: AGXT; (-) strand; PAM type: YTN; PAM sequence: TTC
catcaagaagccccacgtaa

SEQ ID NO: 14062 - DNA, 20 bp, Artificial Sequence
  Description of Artificial Sequence: Synthetic oligonucleotide
  Target: AGXT; (-) strand; PAM type: YTN; PAM sequence: TTG
tgcacggaggcacgtgatgg

SEQ ID NO: 14063 - DNA, 20 bp, Artificial Sequence
  Description of Artificial Sequence: Synthetic oligonucleotide
  Target: AGXT; (-) strand; PAM type: YTN; PAM sequence: CTT
gtgcacggaggcacgtgatg

SEQ ID NO: 14064 - DNA, 20 bp, Artificial Sequence
  Description of Artificial Sequence: Synthetic oligonucleotide
  Target: AGXT; (-) strand; PAM type: YTN; PAM sequence: CTC
ggtcatgaagggaataaagg

SEQ ID NO: 14065 - DNA, 20 bp, Artificial Sequence
  Description of Artificial Sequence: Synthetic oligonucleotide
  Target: AGXT; (-) strand; PAM type: YTN; PAM sequence: CTC
tcggtcatgaagggaataaa

SEQ ID NO: 14066 - DNA, 20 bp, Artificial Sequence
  Description of Artificial Sequence: Synthetic oligonucleotide
  Target: AGXT; (-) strand; PAM type: YTN; PAM sequence: TTG
ctctcggtcatgaagggaat

SEQ ID NO: 14067 - DNA, 20 bp, Artificial Sequence
  Description of Artificial Sequence: Synthetic oligonucleotide
  Target: AGXT; (-) strand; PAM type: YTN; PAM sequence: CTT
gctctcggtcatgaagggaa

SEQ ID NO: 14068 - DNA, 20 bp, Artificial Sequence
  Description of Artificial Sequence: Synthetic oligonucleotide
  Target: AGXT; (-) strand; PAM type: YTN; PAM sequence: TTC
ttgctctcggtcatgaaggg

SEQ ID NO: 14069 - DNA, 20 bp, Artificial Sequence
  Description of Artificial Sequence: Synthetic oligonucleotide
  Target: AGXT; (-) strand; PAM type: YTN; PAM sequence: TTT
cttgctctcggtcatgaagg

SEQ ID NO: 14070 - DNA, 20 bp, Artificial Sequence
  Description of Artificial Sequence: Synthetic oligonucleotide
  Target: AGXT; (-) strand; PAM type: YTN; PAM sequence: CTT
tcttgctctcggtcatgaag

SEQ ID NO: 14071 - DNA, 20 bp, Artificial Sequence
  Description of Artificial Sequence: Synthetic oligonucleotide
  Target: AGXT; (-) strand; PAM type: YTN; PAM sequence: TTC
cctttcttgctctcggtcat

SEQ ID NO: 14072 - DNA, 20 bp, Artificial Sequence
  Description of Artificial Sequence: Synthetic oligonucleotide
  Target: AGXT; (-) strand; PAM type: YTN; PAM sequence: TTT
ccctttcttgctctcggtca

SEQ ID NO: 14073 - DNA, 20 bp, Artificial Sequence
  Description of Artificial Sequence: Synthetic oligonucleotide
  Target: AGXT; (-) strand; PAM type: YTN; PAM sequence: TTT
tccctttcttgctctcggtc

SEQ ID NO: 14074 - DNA, 20 bp, Artificial Sequence
  Description of Artificial Sequence: Synthetic oligonucleotide
  Target: AGXT; (-) strand; PAM type: YTN; PAM sequence: TTT
ttccctttcttgctctcggt

SEQ ID NO: 14075 - DNA, 20 bp, Artificial Sequence
  Description of Artificial Sequence: Synthetic oligonucleotide
  Target: AGXT; (-) strand; PAM type: YTN; PAM sequence: TTC
aggggggtaggtcacgtttt

SEQ ID NO: 14076 - DNA, 20 bp, Artificial Sequence
  Description of Artificial Sequence: Synthetic oligonucleotide
  Target: AGXT; (-) strand; PAM type: YTN; PAM sequence: CTG
aaagggagttcaggggggta

SEQ ID NO: 14077 - DNA, 20 bp, Artificial Sequence
  Description of Artificial Sequence: Synthetic oligonucleotide
  Target: AGXT; (-) strand; PAM type: YTN; PAM sequence: CTG
ctgaaagggagttcaggggg

SEQ ID NO: 14078 - DNA, 20 bp, Artificial Sequence
  Description of Artificial Sequence: Synthetic oligonucleotide
  Target: AGXT; (-) strand; PAM type: YTN; PAM sequence: TTG
ctgctgaaagggagttcagg

SEQ ID NO: 14079 - DNA, 20 bp, Artificial Sequence
  Description of Artificial Sequence: Synthetic oligonucleotide
  Target: AGXT; (-) strand; PAM type: YTN; PAM sequence: CTT
gctgctgaaagggagttcag

SEQ ID NO: 14080 - DNA, 20 bp, Artificial Sequence
  Description of Artificial Sequence: Synthetic oligonucleotide
  Target: AGXT; (-) strand; PAM type: YTN; PAM sequence: CTA
cttgctgctgaaagggagtt

SEQ ID NO: 14081 - DNA, 20 bp, Artificial Sequence
  Description of Artificial Sequence: Synthetic oligonucleotide
  Target: AGXT; (-) strand; PAM type: YTN; PAM sequence: CTG
actacttgctgctgaaaggg

SEQ ID NO: 14082 - DNA, 20 bp, Artificial Sequence
  Description of Artificial Sequence: Synthetic oligonucleotide
  Target: AGXT; (-) strand; PAM type: YTN; PAM sequence: CTC
aagaaaggggaaacggcaca

SEQ ID NO: 14083 - DNA, 20 bp, Artificial Sequence
  Description of Artificial Sequence: Synthetic oligonucleotide
  Target: AGXT; (-) strand; PAM type: YTN; PAM sequence: TTG
gggtctcaagaaaggggaaa

SEQ ID NO: 14084 - DNA, 20 bp, Artificial Sequence
  Description of Artificial Sequence: Synthetic oligonucleotide
  Target: AGXT; (-) strand; PAM type: YTN; PAM sequence: CTG
ttggggtctcaagaaagggg

SEQ ID NO: 14085 - DNA, 20 bp, Artificial Sequence
  Description of Artificial Sequence: Synthetic oligonucleotide
  Target: AGXT; (-) strand; PAM type: YTN; PAM sequence: TTC
ctgttggggtctcaagaaag

SEQ ID NO: 14086 - DNA, 20 bp, Artificial Sequence
  Description of Artificial Sequence: Synthetic oligonucleotide
  Target: AGXT; (-) strand; PAM type: YTN; PAM sequence: CTT
cctgttggggtctcaagaaa

SEQ ID NO: 14087 - DNA, 20 bp, Artificial Sequence
  Description of Artificial Sequence: Synthetic oligonucleotide
  Target: AGXT; (-) strand; PAM type: YTN; PAM sequence: CTG
cttcctgttggggtctcaag

SEQ ID NO: 14088 - DNA, 20 bp, Artificial Sequence
  Description of Artificial Sequence: Synthetic oligonucleotide
  Target: AGXT; (-) strand; PAM type: YTN; PAM sequence: CTC
atgtccacctgcttcctgtt

SEQ ID NO: 14089 - DNA, 20 bp, Artificial Sequence
  Description of Artificial Sequence: Synthetic oligonucleotide
  Target: AGXT; (-) strand; PAM type: YTN; PAM sequence: CTG
ccatgctcatgtccacctgc

SEQ ID NO: 14090 - DNA, 20 bp, Artificial Sequence
  Description of Artificial Sequence: Synthetic oligonucleotide
  Target: AGXT; (-) strand; PAM type: YTN; PAM sequence: TTC
tgccatgctcatgtccacct

SEQ ID NO: 14091 - DNA, 20 bp, Artificial Sequence
  Description of Artificial Sequence: Synthetic oligonucleotide
  Target: AGXT; (-) strand; PAM type: YTN; PAM sequence: TTT
ctgccatgctcatgtccacc

SEQ ID NO: 14092 - DNA, 20 bp, Artificial Sequence
  Description of Artificial Sequence: Synthetic oligonucleotide
  Target: AGXT; (-) strand; PAM type: YTN; PAM sequence: TTT
tctgccatgctcatgtccac

SEQ ID NO: 14093 - DNA, 20 bp, Artificial Sequence
  Description of Artificial Sequence: Synthetic oligonucleotide
  Target: AGXT; (-) strand; PAM type: YTN; PAM sequence: CTT
ttctgccatgctcatgtcca

SEQ ID NO: 14094 - DNA, 20 bp, Artificial Sequence
  Description of Artificial Sequence: Synthetic oligonucleotide
  Target: AGXT; (-) strand; PAM type: YTN; PAM sequence: TTC
cttttctgccatgctcatgt

SEQ ID NO: 14095 - DNA, 20 bp, Artificial Sequence
  Description of Artificial Sequence: Synthetic oligonucleotide
  Target: AGXT; (-) strand; PAM type: YTN; PAM sequence: CTT
ccttttctgccatgctcatg

SEQ ID NO: 14096 - DNA, 20 bp, Artificial Sequence
  Description of Artificial Sequence: Synthetic oligonucleotide
  Target: AGXT; (-) strand; PAM type: YTN; PAM sequence: TTG
acccttccttttctgccatg

SEQ ID NO: 14097 - DNA, 20 bp, Artificial Sequence
  Description of Artificial Sequence: Synthetic oligonucleotide
  Target: AGXT; (-) strand; PAM type: YTN; PAM sequence: TTT
gacccttccttttctgccat

SEQ ID NO: 14098 - DNA, 20 bp, Artificial Sequence
  Description of Artificial Sequence: Synthetic oligonucleotide
  Target: AGXT; (-) strand; PAM type: YTN; PAM sequence: CTT
tgacccttccttttctgcca

SEQ ID NO: 14099 - DNA, 20 bp, Artificial Sequence
  Description of Artificial Sequence: Synthetic oligonucleotide
  Target: AGXT; (-) strand; PAM type: YTN; PAM sequence: TTG
gtgaaatctttgacccttcc

SEQ ID NO: 14100 - DNA, 20 bp, Artificial Sequence
  Description of Artificial Sequence: Synthetic oligonucleotide
  Target: AGXT; (-) strand; PAM type: YTN; PAM sequence: CTT
ggtgaaatctttgacccttc

SEQ ID NO: 14101 - DNA, 20 bp, Artificial Sequence
  Description of Artificial Sequence: Synthetic oligonucleotide
  Target: AGXT; (-) strand; PAM type: YTN; PAM sequence: CTG
acaaatatcttggtgaaatc

SEQ ID NO: 14102 - DNA, 20 bp, Artificial Sequence
  Description of Artificial Sequence: Synthetic oligonucleotide
  Target: AGXT; (-) strand; PAM type: YTN; PAM sequence: CTC
tgacaaatatcttggtgaaa

SEQ ID NO: 14103 - DNA, 20 bp, Artificial Sequence
  Description of Artificial Sequence: Synthetic oligonucleotide
  Target: AGXT; (-) strand; PAM type: YTN; PAM sequence: TTC
cctctgacaaatatcttggt

SEQ ID NO: 14104 - DNA, 20 bp, Artificial Sequence
  Description of Artificial Sequence: Synthetic oligonucleotide
  Target: AGXT; (-) strand; PAM type: YTN; PAM sequence: TTT
ccctctgacaaatatcttgg

SEQ ID NO: 14105 - DNA, 20 bp, Artificial Sequence
  Description of Artificial Sequence: Synthetic oligonucleotide
  Target: AGXT; (-) strand; PAM type: YTN; PAM sequence: TTT
tccctctgacaaatatcttg

SEQ ID NO: 14106 - DNA, 20 bp, Artificial Sequence
  Description of Artificial Sequence: Synthetic oligonucleotide
  Target: AGXT; (-) strand; PAM type: YTN; PAM sequence: CTC
attttccctctgacaaatat

SEQ ID NO: 14107 - DNA, 20 bp, Artificial Sequence
  Description of Artificial Sequence: Synthetic oligonucleotide
  Target: AGXT; (-) strand; PAM type: YTN; PAM sequence: CTG
tcctcattttccctctgaca

SEQ ID NO: 14108 - DNA, 20 bp, Artificial Sequence
  Description of Artificial Sequence: Synthetic oligonucleotide
  Target: AGXT; (-) strand; PAM type: YTN; PAM sequence: TTG
ctgtcctcattttccctctg

SEQ ID NO: 14109 - DNA, 20 bp, Artificial Sequence
  Description of Artificial Sequence: Synthetic oligonucleotide
  Target: AGXT; (-) strand; PAM type: YTN; PAM sequence: TTT
gctgtcctcattttccctct

SEQ ID NO: 14110 - DNA, 20 bp, Artificial Sequence
  Description of Artificial Sequence: Synthetic oligonucleotide
  Target: AGXT; (-) strand; PAM type: YTN; PAM sequence: CTT
tgctgtcctcattttccctc

SEQ ID NO: 14111 - DNA, 20 bp, Artificial Sequence
  Description of Artificial Sequence: Synthetic oligonucleotide
  Target: AGXT; (-) strand; PAM type: YTN; PAM sequence: CTC
caggtgatctttgctgtcct

SEQ ID NO: 14112 - DNA, 20 bp, Artificial Sequence
  Description of Artificial Sequence: Synthetic oligonucleotide
  Target: AGXT; (-) strand; PAM type: YTN; PAM sequence: TTG
atggtctccaggtgatcttt

SEQ ID NO: 14113 - DNA, 20 bp, Artificial Sequence
  Description of Artificial Sequence: Synthetic oligonucleotide
  Target: AGXT; (-) strand; PAM type: YTN; PAM sequence: CTT
gatggtctccaggtgatctt

SEQ ID NO: 14114 - DNA, 20 bp, Artificial Sequence
  Description of Artificial Sequence: Synthetic oligonucleotide
  Target: AGXT; (-) strand; PAM type: YTN; PAM sequence: CTG
cttgatggtctccaggtgat

SEQ ID NO: 14115 - DNA, 20 bp, Artificial Sequence
  Description of Artificial Sequence: Synthetic oligonucleotide
  Target: AGXT; (-) strand; PAM type: YTN; PAM sequence: CTG
gggcctgcttgatggtctcc

SEQ ID NO: 14116 - DNA, 20 bp, Artificial Sequence
  Description of Artificial Sequence: Synthetic oligonucleotide
  Target: AGXT; (-) strand; PAM type: YTN; PAM sequence: CTC
cacccaccccacctggggcc

SEQ ID NO: 14117 - DNA, 20 bp, Artificial Sequence
  Description of Artificial Sequence: Synthetic oligonucleotide
  Target: AGXT; (-) strand; PAM type: YTN; PAM sequence: CTC
ccctccacccaccccacctg

SEQ ID NO: 14118 - DNA, 20 bp, Artificial Sequence
  Description of Artificial Sequence: Synthetic oligonucleotide
  Target: AGXT; (-) strand; PAM type: YTN; PAM sequence: CTC
aaataaagaggctcccctcc

SEQ ID NO: 14119 - DNA, 20 bp, Artificial Sequence
  Description of Artificial Sequence: Synthetic oligonucleotide
  Target: AGXT; (-) strand; PAM type: YTN; PAM sequence: TTC
tcaaataaagaggctcccct

SEQ ID NO: 14120 - DNA, 20 bp, Artificial Sequence
  Description of Artificial Sequence: Synthetic oligonucleotide
  Target: AGXT; (-) strand; PAM type: YTN; PAM sequence: TTT
ctcaaataaagaggctcccc

SEQ ID NO: 14121 - DNA, 20 bp, Artificial Sequence
  Description of Artificial Sequence: Synthetic oligonucleotide
  Target: AGXT; (-) strand; PAM type: YTN; PAM sequence: CTA
catttctcaaataaagaggc

SEQ ID NO: 14122 - DNA, 20 bp, Artificial Sequence
  Description of Artificial Sequence: Synthetic oligonucleotide
  Target: AGXT; (-) strand; PAM type: YTN; PAM sequence: TTC
tacatttctcaaataaagag

SEQ ID NO: 14123 - DNA, 20 bp, Artificial Sequence
  Description of Artificial Sequence: Synthetic oligonucleotide
  Target: AGXT; (-) strand; PAM type: YTN; PAM sequence: TTC
attctacatttctcaaataa

SEQ ID NO: 14124 - DNA, 20 bp, Artificial Sequence
  Description of Artificial Sequence: Synthetic oligonucleotide
  Target: AGXT; (-) strand; PAM type: YTN; PAM sequence: CTA
attcattctacatttctcaa

SEQ ID NO: 14125 - DNA, 20 bp, Artificial Sequence
  Description of Artificial Sequence: Synthetic oligonucleotide
  Target: AGXT; (-) strand; PAM type: YTN; PAM sequence: TTA
gataatagggaagtctaatt

SEQ ID NO: 14126 - DNA, 20 bp, Artificial Sequence
  Description of Artificial Sequence: Synthetic oligonucleotide
  Target: AGXT; (-) strand; PAM type: YTN; PAM sequence: TTT
agataatagggaagtctaat

SEQ ID NO: 14127 - DNA, 20 bp, Artificial Sequence
  Description of Artificial Sequence: Synthetic oligonucleotide
  Target: AGXT; (-) strand; PAM type: YTN; PAM sequence: CTT
tagataatagggaagtctaa

SEQ ID NO: 14128 - DNA, 20 bp, Artificial Sequence
  Description of Artificial Sequence: Synthetic oligonucleotide
  Target: AGXT; (-) strand; PAM type: YTN; PAM sequence: CTG
gaaccaggtgccaactttag

SEQ ID NO: 14129 - DNA, 20 bp, Artificial Sequence
  Description of Artificial Sequence: Synthetic oligonucleotide
  Target: AGXT; (-) strand; PAM type: YTN; PAM sequence: TTG
aaaagaggcctggaaccagg

SEQ ID NO: 14130 - DNA, 20 bp, Artificial Sequence
  Description of Artificial Sequence: Synthetic oligonucleotide
  Target: AGXT; (-) strand; PAM type: YTN; PAM sequence: TTA
ggttgaaaagaggcctggaa

SEQ ID NO: 14131 - DNA, 20 bp, Artificial Sequence
  Description of Artificial Sequence: Synthetic oligonucleotide
  Target: AGXT; (-) strand; PAM type: YTN; PAM sequence: TTT
aggttgaaaagaggcctgga

SEQ ID NO: 14132 - DNA, 20 bp, Artificial Sequence
  Description of Artificial Sequence: Synthetic oligonucleotide
  Target: AGXT; (-) strand; PAM type: YTN; PAM sequence: TTT
taggttgaaaagaggcctgg

SEQ ID NO: 14133 - DNA, 20 bp, Artificial Sequence
  Description of Artificial Sequence: Synthetic oligonucleotide
  Target: AGXT; (-) strand; PAM type: YTN; PAM sequence: TTA
tgtataagttttaggttgaa

SEQ ID NO: 14134 - DNA, 20 bp, Artificial Sequence
  Description of Artificial Sequence: Synthetic oligonucleotide
  Target: AGXT; (-) strand; PAM type: YTN; PAM sequence: CTA
gttatgtataagttttaggt

SEQ ID NO: 14135 - DNA, 20 bp, Artificial Sequence
  Description of Artificial Sequence: Synthetic oligonucleotide
  Target: AGXT; (-) strand; PAM type: YTN; PAM sequence: TTC
tagttatgtataagttttag

SEQ ID NO: 14136 - DNA, 20 bp, Artificial Sequence
  Description of Artificial Sequence: Synthetic oligonucleotide
  Target: AGXT; (-) strand; PAM type: YTN; PAM sequence: TTC
cagagatgtatagaaattct

SEQ ID NO: 14137 - DNA, 20 bp, Artificial Sequence
  Description of Artificial Sequence: Synthetic oligonucleotide
  Target: AGXT; (-) strand; PAM type: YTN; PAM sequence: CTG
cattccagagatgtatagaa

SEQ ID NO: 14138 - DNA, 20 bp, Artificial Sequence
  Description of Artificial Sequence: Synthetic oligonucleotide
  Target: AGXT; (-) strand; PAM type: YTN; PAM sequence: TTC
agcatgctgcattccagaga

SEQ ID NO: 14139 - DNA, 20 bp, Artificial Sequence
  Description of Artificial Sequence: Synthetic oligonucleotide
  Target: AGXT; (-) strand; PAM type: YTN; PAM sequence: TTT
cagcatgctgcattccagag

SEQ ID NO: 14140 - DNA, 20 bp, Artificial Sequence
  Description of Artificial Sequence: Synthetic oligonucleotide
  Target: AGXT; (-) strand; PAM type: YTN; PAM sequence: TTG
cacagtgagtttcagcatgc

SEQ ID NO: 14141 - DNA, 20 bp, Artificial Sequence
  Description of Artificial Sequence: Synthetic oligonucleotide
  Target: AGXT; (-) strand; PAM type: YTN; PAM sequence: CTG
catggtatacagacacacac

SEQ ID NO: 14142 - DNA, 20 bp, Artificial Sequence
  Description of Artificial Sequence: Synthetic oligonucleotide
  Target: AGXT; (-) strand; PAM type: YTN; PAM sequence: TTA
gcaagcaaacctgcatggta

SEQ ID NO: 14143 - DNA, 20 bp, Artificial Sequence
  Description of Artificial Sequence: Synthetic oligonucleotide
  Target: AGXT; (-) strand; PAM type: YTN; PAM sequence: TTT
agcaagcaaacctgcatggt

SEQ ID NO: 14144 - DNA, 20 bp, Artificial Sequence
  Description of Artificial Sequence: Synthetic oligonucleotide
  Target: AGXT; (-) strand; PAM type: YTN; PAM sequence: CTC
aatttagcaagcaaacctgc

SEQ ID NO: 14145 - DNA, 20 bp, Artificial Sequence
  Description of Artificial Sequence: Synthetic oligonucleotide
  Target: AGXT; (-) strand; PAM type: YTN; PAM sequence: TTA
caggctcaatttagcaagca

SEQ ID NO: 14146 - DNA, 20 bp, Artificial Sequence
  Description of Artificial Sequence: Synthetic oligonucleotide
  Target: AGXT; (-) strand; PAM type: YTN; PAM sequence: TTT
acaggctcaatttagcaagc

SEQ ID NO: 14147 - DNA, 20 bp, Artificial Sequence
  Description of Artificial Sequence: Synthetic oligonucleotide
  Target: AGXT; (-) strand; PAM type: YTN; PAM sequence: TTG
gtttacaggctcaatttagc

SEQ ID NO: 14148 - DNA, 20 bp, Artificial Sequence
  Description of Artificial Sequence: Synthetic oligonucleotide
  Target: AGXT; (-) strand; PAM type: YTN; PAM sequence: TTT
ggtttacaggctcaatttag

SEQ ID NO: 14149 - DNA, 20 bp, Artificial Sequence
  Description of Artificial Sequence: Synthetic oligonucleotide
  Target: AGXT; (-) strand; PAM type: YTN; PAM sequence: TTT
tggtttacaggctcaattta

SEQ ID NO: 14150 - DNA, 20 bp, Artificial Sequence
  Description of Artificial Sequence: Synthetic oligonucleotide
  Target: AGXT; (-) strand; PAM type: YTN; PAM sequence: TTT
ttggtttacaggctcaattt

SEQ ID NO: 14151 - DNA, 20 bp, Artificial Sequence
  Description of Artificial Sequence: Synthetic oligonucleotide
  Target: AGXT; (-) strand; PAM type: YTN; PAM sequence: CTT
tttggtttacaggctcaatt

SEQ ID NO: 14152 - DNA, 20 bp, Artificial Sequence
  Description of Artificial Sequence: Synthetic oligonucleotide
  Target: AGXT; (-) strand; PAM type: YTN; PAM sequence: TTG
aggtactttttggtttacag

SEQ ID NO: 14153 - DNA, 20 bp, Artificial Sequence
  Description of Artificial Sequence: Synthetic oligonucleotide
  Target: AGXT; (-) strand; PAM type: YTN; PAM sequence: TTT
gaggtactttttggtttaca

SEQ ID NO: 14154 - DNA, 20 bp, Artificial Sequence
  Description of Artificial Sequence: Synthetic oligonucleotide
  Target: AGXT; (-) strand; PAM type: YTN; PAM sequence: CTG
tttgaggtactttttggttt

SEQ ID NO: 14155 - DNA, 20 bp, Artificial Sequence
  Description of Artificial Sequence: Synthetic oligonucleotide
  Target: AGXT; (-) strand; PAM type: YTN; PAM sequence: TTG
agacctgtttgaggtacttt

SEQ ID NO: 14156 - DNA, 20 bp, Artificial Sequence
  Description of Artificial Sequence: Synthetic oligonucleotide
  Target: AGXT; (-) strand; PAM type: YTN; PAM sequence: TTA
attgagacctgtttgaggta

SEQ ID NO: 14157 - DNA, 20 bp, Artificial Sequence
  Description of Artificial Sequence: Synthetic oligonucleotide
  Target: AGXT; (-) strand; PAM type: YTN; PAM sequence: CTA
aattaattgagacctgtttg

SEQ ID NO: 14158 - DNA, 20 bp, Artificial Sequence
  Description of Artificial Sequence: Synthetic oligonucleotide
  Target: AGXT; (-) strand; PAM type: YTN; PAM sequence: TTC
taaattaattgagacctgtt

SEQ ID NO: 14159 - DNA, 20 bp, Artificial Sequence
  Description of Artificial Sequence: Synthetic oligonucleotide
  Target: AGXT; (-) strand; PAM type: YTN; PAM sequence: TTT
ctaaattaattgagacctgt

SEQ ID NO: 14160 - DNA, 20 bp, Artificial Sequence
  Description of Artificial Sequence: Synthetic oligonucleotide
  Target: AGXT; (-) strand; PAM type: YTN; PAM sequence: CTT
tctaaattaattgagacctg

SEQ ID NO: 14161 - DNA, 20 bp, Artificial Sequence
  Description of Artificial Sequence: Synthetic oligonucleotide
  Target: AGXT; (-) strand; PAM type: YTN; PAM sequence: TTG
gcaacaaaaactttctaaat

SEQ ID NO: 14162 - DNA, 20 bp, Artificial Sequence
  Description of Artificial Sequence: Synthetic oligonucleotide
  Target: AGXT; (-) strand; PAM type: YTN; PAM sequence: CTT
ggcaacaaaaactttctaaa

SEQ ID NO: 14163 - DNA, 20 bp, Artificial Sequence
  Description of Artificial Sequence: Synthetic oligonucleotide
  Target: AGXT; (-) strand; PAM type: YTN; PAM sequence: TTA
gccttggcaacaaaaacttt

SEQ ID NO: 14164 - DNA, 20 bp, Artificial Sequence
  Description of Artificial Sequence: Synthetic oligonucleotide
  Target: AGXT; (-) strand; PAM type: YTN; PAM sequence: CTT
agccttggcaacaaaaactt

SEQ ID NO: 14165 - DNA, 20 bp, Artificial Sequence
  Description of Artificial Sequence: Synthetic oligonucleotide
  Target: AGXT; (-) strand; PAM type: YTN; PAM sequence: CTG
taccacgggtgcatccttag

SEQ ID NO: 14166 - DNA, 20 bp, Artificial Sequence
  Description of Artificial Sequence: Synthetic oligonucleotide
  Target: AGXT; (-) strand; PAM type: YTN; PAM sequence: CTG
aggctgtaccacgggtgcat

SEQ ID NO: 14167 - DNA, 20 bp, Artificial Sequence
  Description of Artificial Sequence: Synthetic oligonucleotide
  Target: AGXT; (-) strand; PAM type: YTN; PAM sequence: CTC
ctgaggctgtaccacgggtg

SEQ ID NO: 14168 - DNA, 20 bp, Artificial Sequence
  Description of Artificial Sequence: Synthetic oligonucleotide
  Target: AGXT; (-) strand; PAM type: YTN; PAM sequence: CTC
cctcctgaggctgtaccacg

SEQ ID NO: 14169 - DNA, 20 bp, Artificial Sequence
  Description of Artificial Sequence: Synthetic oligonucleotide
  Target: AGXT; (-) strand; PAM type: YTN; PAM sequence: TTG
gcaaggatgtcctccctcct

SEQ ID NO: 14170 - DNA, 20 bp, Artificial Sequence
  Description of Artificial Sequence: Synthetic oligonucleotide
  Target: AGXT; (-) strand; PAM type: YTN; PAM sequence: CTT
ggcaaggatgtcctccctcc

SEQ ID NO: 14171 - DNA, 20 bp, Artificial Sequence
  Description of Artificial Sequence: Synthetic oligonucleotide
  Target: AGXT; (-) strand; PAM type: YTN; PAM sequence: TTG
agcttggcaaggatgtcctc

SEQ ID NO: 14172 - DNA, 20 bp, Artificial Sequence
  Description of Artificial Sequence: Synthetic oligonucleotide
  Target: AGXT; (-) strand; PAM type: YTN; PAM sequence: CTT
gagcttggcaaggatgtcct

SEQ ID NO: 14173 - DNA, 20 bp, Artificial Sequence
  Description of Artificial Sequence: Synthetic oligonucleotide
  Target: AGXT; (-) strand; PAM type: YTN; PAM sequence: TTG
tggtcaggggtgcacccttg

SEQ ID NO: 14174 - DNA, 20 bp, Artificial Sequence
  Description of Artificial Sequence: Synthetic oligonucleotide
  Target: AGXT; (-) strand; PAM type: YTN; PAM sequence: CTT
gtggtcaggggtgcaccctt

SEQ ID NO: 14175 - DNA, 20 bp, Artificial Sequence
  Description of Artificial Sequence: Synthetic oligonucleotide
  Target: AGXT; (-) strand; PAM type: YTN; PAM sequence: TTG
ggcccttgtggtcaggggtg

SEQ ID NO: 14176 - DNA, 20 bp, Artificial Sequence
  Description of Artificial Sequence: Synthetic oligonucleotide
  Target: AGXT; (-) strand; PAM type: YTN; PAM sequence: CTT
gggcccttgtggtcaggggt

SEQ ID NO: 14177 - DNA, 20 bp, Artificial Sequence
  Description of Artificial Sequence: Synthetic oligonucleotide
  Target: AGXT; (-) strand; PAM type: YTN; PAM sequence: CTG
tgccccgaccaccttgggcc

SEQ ID NO: 14178 - DNA, 20 bp, Artificial Sequence
  Description of Artificial Sequence: Synthetic oligonucleotide
  Target: AGXT; (-) strand; PAM type: YTN; PAM sequence: CTA
aaatgtataaaagcaagctg

SEQ ID NO: 14179 - DNA, 20 bp, Artificial Sequence
  Description of Artificial Sequence: Synthetic oligonucleotide
  Target: AGXT; (-) strand; PAM type: YTN; PAM sequence: CTC
cctaaaatgtataaaagcaa

SEQ ID NO: 14180 - DNA, 20 bp, Artificial Sequence
  Description of Artificial Sequence: Synthetic oligonucleotide
  Target: AGXT; (-) strand; PAM type: YTN; PAM sequence: CTC
atatctccctaaaatgtata

SEQ ID NO: 14181 - DNA, 20 bp, Artificial Sequence
  Description of Artificial Sequence: Synthetic oligonucleotide
  Target: AGXT; (-) strand; PAM type: YTN; PAM sequence: TTG
atgcctcatatctccctaaa

SEQ ID NO: 14182 - DNA, 20 bp, Artificial Sequence
  Description of Artificial Sequence: Synthetic oligonucleotide
  Target: AGXT; (-) strand; PAM type: YTN; PAM sequence: TTG
attgatgcctcatatctccc

SEQ ID NO: 14183 - DNA, 20 bp, Artificial Sequence
  Description of Artificial Sequence: Synthetic oligonucleotide
  Target: AGXT; (-) strand; PAM type: YTN; PAM sequence: CTC
ccatgtattgattgatgcct

SEQ ID NO: 14184 - DNA, 20 bp, Artificial Sequence
  Description of Artificial Sequence: Synthetic oligonucleotide
  Target: AGXT; (-) strand; PAM type: YTN; PAM sequence: TTC
cagatggaaccaatgtaaat

SEQ ID NO: 14185 - DNA, 20 bp, Artificial Sequence
  Description of Artificial Sequence: Synthetic oligonucleotide
  Target: AGXT; (-) strand; PAM type: YTN; PAM sequence: CTT
ccagatggaaccaatgtaaa

SEQ ID NO: 14186 - DNA, 20 bp, Artificial Sequence
  Description of Artificial Sequence: Synthetic oligonucleotide
  Target: AGXT; (-) strand; PAM type: YTN; PAM sequence: TTG
tcccgcccttccagatggaa

SEQ ID NO: 14187 - DNA, 20 bp, Artificial Sequence
  Description of Artificial Sequence: Synthetic oligonucleotide
  Target: AGXT; (-) strand; PAM type: YTN; PAM sequence: TTC
aagttgtcccgcccttccag

SEQ ID NO: 14188 - DNA, 20 bp, Artificial Sequence
  Description of Artificial Sequence: Synthetic oligonucleotide
  Target: AGXT; (-) strand; PAM type: YTN; PAM sequence: CTG
gaagccccccaattcaagtt

SEQ ID NO: 14189 - DNA, 20 bp, Artificial Sequence
  Description of Artificial Sequence: Synthetic oligonucleotide
  Target: AGXT; (-) strand; PAM type: YTN; PAM sequence: CTA
tgacctggaagccccccaat

SEQ ID NO: 14190 - DNA, 20 bp, Artificial Sequence
  Description of Artificial Sequence: Synthetic oligonucleotide
  Target: AGXT; (-) strand; PAM type: YTN; PAM sequence: CTA
cctatgacctggaagccccc

SEQ ID NO: 14191 - DNA, 20 bp, Artificial Sequence
  Description of Artificial Sequence: Synthetic oligonucleotide
  Target: AGXT; (-) strand; PAM type: YTN; PAM sequence: TTA
aatctacctatgacctggaa

SEQ ID NO: 14192 - DNA, 20 bp, Artificial Sequence
  Description of Artificial Sequence: Synthetic oligonucleotide
  Target: AGXT; (-) strand; PAM type: YTN; PAM sequence: TTT
aaatctacctatgacctgga

SEQ ID NO: 14193 - DNA, 20 bp, Artificial Sequence
  Description of Artificial Sequence: Synthetic oligonucleotide
  Target: AGXT; (-) strand; PAM type: YTN; PAM sequence: TTG
ccaatcaaaatatgtttaaa

SEQ ID NO: 14194 - DNA, 20 bp, Artificial Sequence
  Description of Artificial Sequence: Synthetic oligonucleotide
  Target: AGXT; (-) strand; PAM type: YTN; PAM sequence: TTC
agtcagttgccaatcaaaat

SEQ ID NO: 14195 - DNA, 20 bp, Artificial Sequence
  Description of Artificial Sequence: Synthetic oligonucleotide
  Target: AGXT; (-) strand; PAM type: YTN; PAM sequence: CTT
cagtcagttgccaatcaaaa

SEQ ID NO: 14196 - DNA, 20 bp, Artificial Sequence
  Description of Artificial Sequence: Synthetic oligonucleotide
  Target: AGXT; (-) strand; PAM type: YTN; PAM sequence: TTC
ttcagtcagttgccaatcaa

SEQ ID NO: 14197 - DNA, 20 bp, Artificial Sequence
  Description of Artificial Sequence: Synthetic oligonucleotide
  Target: AGXT; (-) strand; PAM type: YTN; PAM sequence: CTG
ataataattcttcagtcagt

SEQ ID NO: 14198 - DNA, 20 bp, Artificial Sequence
  Description of Artificial Sequence: Synthetic oligonucleotide
  Target: AGXT; (-) strand; PAM type: YTN; PAM sequence: CTG
ctgataataattcttcagtc

SEQ ID NO: 14199 - DNA, 20 bp, Artificial Sequence
  Description of Artificial Sequence: Synthetic oligonucleotide
  Target: AGXT; (-) strand; PAM type: YTN; PAM sequence: TTC
tgctgataataattcttcag

SEQ ID NO: 14200 - DNA, 20 bp, Artificial Sequence
  Description of Artificial Sequence: Synthetic oligonucleotide
  Target: AGXT; (-) strand; PAM type: YTN; PAM sequence: TTT
ctgctgataataattcttca

SEQ ID NO: 14201 - DNA, 20 bp, Artificial Sequence
  Description of Artificial Sequence: Synthetic oligonucleotide
  Target: AGXT; (-) strand; PAM type: YTN; PAM sequence: CTT
tctgctgataataattcttc

SEQ ID NO: 14202 - DNA, 20 bp, Artificial Sequence
  Description of Artificial Sequence: Synthetic oligonucleotide
  Target: AGXT; (-) strand; PAM type: YTN; PAM sequence: CTC
ctttctgctgataataattc

SEQ ID NO: 14203 - DNA, 20 bp, Artificial Sequence
  Description of Artificial Sequence: Synthetic oligonucleotide
  Target: AGXT; (-) strand; PAM type: YTN; PAM sequence: TTC
ataacccagacactcctttc

SEQ ID NO: 14204 - DNA, 20 bp, Artificial Sequence
  Description of Artificial Sequence: Synthetic oligonucleotide
  Target: AGXT; (-) strand; PAM type: YTN; PAM sequence: TTT
cataacccagacactccttt

SEQ ID NO: 14205 - DNA, 20 bp, Artificial Sequence
  Description of Artificial Sequence: Synthetic oligonucleotide
  Target: AGXT; (-) strand; PAM type: YTN; PAM sequence: CTA
tttcataacccagacactcc

SEQ ID NO: 14206 - DNA, 20 bp, Artificial Sequence
  Description of Artificial Sequence: Synthetic oligonucleotide
  Target: AGXT; (-) strand; PAM type: YTN; PAM sequence: CTG
caacccctatttcataaccc

SEQ ID NO: 14207 - DNA, 20 bp, Artificial Sequence
  Description of Artificial Sequence: Synthetic oligonucleotide
  Target: AGXT; (-) strand; PAM type: YTN; PAM sequence: CTC
cctgcaacccctatttcata

SEQ ID NO: 14208 - DNA, 20 bp, Artificial Sequence
  Description of Artificial Sequence: Synthetic oligonucleotide
  Target: AGXT; (-) strand; PAM type: YTN; PAM sequence: CTG
ctccctgcaacccctatttc

SEQ ID NO: 14209 - DNA, 20 bp, Artificial Sequence
  Description of Artificial Sequence: Synthetic oligonucleotide
  Target: AGXT; (-) strand; PAM type: YTN; PAM sequence: CTG
aaggcatcatctgctccctg

SEQ ID NO: 14210 - DNA, 20 bp, Artificial Sequence
  Description of Artificial Sequence: Synthetic oligonucleotide
  Target: AGXT; (-) strand; PAM type: YTN; PAM sequence: CTA
cctgaaggcatcatctgctc

SEQ ID NO: 14211 - DNA, 20 bp, Artificial Sequence
  Description of Artificial Sequence: Synthetic oligonucleotide
  Target: AGXT; (-) strand; PAM type: YTN; PAM sequence: CTA
aatcccgctacctgaaggca

SEQ ID NO: 14212 - DNA, 20 bp, Artificial Sequence
  Description of Artificial Sequence: Synthetic oligonucleotide
  Target: AGXT; (-) strand; PAM type: YTN; PAM sequence: CTC
taaatcccgctacctgaagg

SEQ ID NO: 14213 - DNA, 20 bp, Artificial Sequence
  Description of Artificial Sequence: Synthetic oligonucleotide
  Target: AGXT; (-) strand; PAM type: YTN; PAM sequence: CTC
tctaaatcccgctacctgaa

SEQ ID NO: 14214 - DNA, 20 bp, Artificial Sequence
  Description of Artificial Sequence: Synthetic oligonucleotide
  Target: AGXT; (-) strand; PAM type: YTN; PAM sequence: TTC
tctctaaatcccgctacctg

SEQ ID NO: 14215 - DNA, 20 bp, Artificial Sequence
  Description of Artificial Sequence: Synthetic oligonucleotide
  Target: AGXT; (-) strand; PAM type: YTN; PAM sequence: TTT
ctctctaaatcccgctacct

SEQ ID NO: 14216 - DNA, 20 bp, Artificial Sequence
  Description of Artificial Sequence: Synthetic oligonucleotide
  Target: AGXT; (-) strand; PAM type: YTN; PAM sequence: TTT
tctctctaaatcccgctacc

SEQ ID NO: 14217 - DNA, 20 bp, Artificial Sequence
  Description of Artificial Sequence: Synthetic oligonucleotide
  Target: AGXT; (-) strand; PAM type: YTN; PAM sequence: CTA
ttttctctctaaatcccgct

SEQ ID NO: 14218 - DNA, 20 bp, Artificial Sequence
  Description of Artificial Sequence: Synthetic oligonucleotide
  Target: AGXT; (-) strand; PAM type: YTN; PAM sequence: TTA
ccatctattttctctctaaa

SEQ ID NO: 14219 - DNA, 20 bp, Artificial Sequence
  Description of Artificial Sequence: Synthetic oligonucleotide
  Target: AGXT; (-) strand; PAM type: YTN; PAM sequence: TTT
accatctattttctctctaa

SEQ ID NO: 14220 - DNA, 20 bp, Artificial Sequence
  Description of Artificial Sequence: Synthetic oligonucleotide
  Target: AGXT; (-) strand; PAM type: YTN; PAM sequence: CTG
ataggaagcatttaccatct

SEQ ID NO: 14221 - DNA, 20 bp, Artificial Sequence
  Description of Artificial Sequence: Synthetic oligonucleotide
  Target: AGXT; (-) strand; PAM type: YTN; PAM sequence: TTA
agtctgataggaagcattta

SEQ ID NO: 14222 - DNA, 20 bp, Artificial Sequence
  Description of Artificial Sequence: Synthetic oligonucleotide
  Target: AGXT; (-) strand; PAM type: YTN; PAM sequence: CTT
aagtctgataggaagcattt

SEQ ID NO: 14223 - DNA, 20 bp, Artificial Sequence
  Description of Artificial Sequence: Synthetic oligonucleotide
  Target: AGXT; (-) strand; PAM type: YTN; PAM sequence: TTA
acatcgacatagaccttaag

SEQ ID NO: 14224 - DNA, 20 bp, Artificial Sequence
  Description of Artificial Sequence: Synthetic oligonucleotide
  Target: AGXT; (-) strand; PAM type: YTN; PAM sequence: TTC
aggccatgccacatcataac

SEQ ID NO: 14225 - DNA, 20 bp, Artificial Sequence
  Description of Artificial Sequence: Synthetic oligonucleotide
  Target: AGXT; (-) strand; PAM type: YTN; PAM sequence: TTA
acccggaagacgttcaggcc

SEQ ID NO: 14226 - DNA, 20 bp, Artificial Sequence
  Description of Artificial Sequence: Synthetic oligonucleotide
  Target: AGXT; (-) strand; PAM type: YTN; PAM sequence: TTT
aacccggaagacgttcaggc

SEQ ID NO: 14227 - DNA, 20 bp, Artificial Sequence
  Description of Artificial Sequence: Synthetic oligonucleotide
  Target: AGXT; (-) strand; PAM type: YTN; PAM sequence: CTT
taacccggaagacgttcagg

SEQ ID NO: 14228 - DNA, 20 bp, Artificial Sequence
  Description of Artificial Sequence: Synthetic oligonucleotide
  Target: AGXT; (-) strand; PAM type: YTN; PAM sequence: CTA
aactttaacccggaagacgt

SEQ ID NO: 14229 - DNA, 20 bp, Artificial Sequence
  Description of Artificial Sequence: Synthetic oligonucleotide
  Target: AGXT; (-) strand; PAM type: YTN; PAM sequence: CTC
taaactttaacccggaagac

SEQ ID NO: 14230 - DNA, 20 bp, Artificial Sequence
  Description of Artificial Sequence: Synthetic oligonucleotide
  Target: AGXT; (-) strand; PAM type: YTN; PAM sequence: CTG
tccgccagggtgctctaaac

SEQ ID NO: 14231 - DNA, 20 bp, Artificial Sequence
  Description of Artificial Sequence: Synthetic oligonucleotide
  Target: AGXT; (-) strand; PAM type: YTN; PAM sequence: TTC
cctgtccgccagggtgctct

SEQ ID NO: 14232 - DNA, 20 bp, Artificial Sequence
  Description of Artificial Sequence: Synthetic oligonucleotide
  Target: AGXT; (-) strand; PAM type: YTN; PAM sequence: CTG
aatggggttccctgtccgcc

SEQ ID NO: 14233 - DNA, 20 bp, Artificial Sequence
  Description of Artificial Sequence: Synthetic oligonucleotide
  Target: AGXT; (-) strand; PAM type: YTN; PAM sequence: TTC
gaaggccccccagcaaccat

SEQ ID NO: 14234 - DNA, 20 bp, Artificial Sequence
  Description of Artificial Sequence: Synthetic oligonucleotide
  Target: AGXT; (-) strand; PAM type: YTN; PAM sequence: TTG
taaaccaaaaataaaattcg

SEQ ID NO: 14235 - DNA, 20 bp, Artificial Sequence
  Description of Artificial Sequence: Synthetic oligonucleotide
  Target: AGXT; (-) strand; PAM type: YTN; PAM sequence: CTT
gtaaaccaaaaataaaattc

SEQ ID NO: 14236 - DNA, 20 bp, Artificial Sequence
  Description of Artificial Sequence: Synthetic oligonucleotide
  Target: AGXT; (-) strand; PAM type: YTN; PAM sequence: CTG
atgggaaggcttgtaaacca

SEQ ID NO: 14237 - DNA, 20 bp, Artificial Sequence
  Description of Artificial Sequence: Synthetic oligonucleotide
  Target: AGXT; (-) strand; PAM type: YTN; PAM sequence: CTG
gcgcagctgatgggaaggct

SEQ ID NO: 14238 - DNA, 20 bp, Artificial Sequence
  Description of Artificial Sequence: Synthetic oligonucleotide
  Target: AGXT; (-) strand; PAM type: YTN; PAM sequence: CTG
accctggcgcagctgatggg

SEQ ID NO: 14239 - DNA, 20 bp, Artificial Sequence
  Description of Artificial Sequence: Synthetic oligonucleotide
  Target: AGXT; (-) strand; PAM type: YTN; PAM sequence: TTG
ctgaccctggcgcagctgat

SEQ ID NO: 14240 - DNA, 20 bp, Artificial Sequence
  Description of Artificial Sequence: Synthetic oligonucleotide
  Target: AGXT; (-) strand; PAM type: YTN; PAM sequence: TTT
gctgaccctggcgcagctga

SEQ ID NO: 14241 - DNA, 20 bp, Artificial Sequence
  Description of Artificial Sequence: Synthetic oligonucleotide
  Target: AGXT; (-) strand; PAM type: YTN; PAM sequence: CTG
tggtttgctgaccctggcgc

SEQ ID NO: 14242 - DNA, 20 bp, Artificial Sequence
  Description of Artificial Sequence: Synthetic oligonucleotide
  Target: AGXT; (-) strand; PAM type: YTN; PAM sequence: TTG
ggcccatggactgtggtttg

SEQ ID NO: 14243 - DNA, 20 bp, Artificial Sequence
  Description of Artificial Sequence: Synthetic oligonucleotide
  Target: AGXT; (-) strand; PAM type: YTN; PAM sequence: TTA
caaaaagcaggtggcaggcc

SEQ ID NO: 14244 - DNA, 20 bp, Artificial Sequence
  Description of Artificial Sequence: Synthetic oligonucleotide
  Target: AGXT; (-) strand; PAM type: YTN; PAM sequence: TTT
acaaaaagcaggtggcaggc

SEQ ID NO: 14245 - DNA, 20 bp, Artificial Sequence
  Description of Artificial Sequence: Synthetic oligonucleotide
  Target: AGXT; (-) strand; PAM type: YTN; PAM sequence: TTA
tttacaaaaagcaggtggca

SEQ ID NO: 14246 - DNA, 20 bp, Artificial Sequence
  Description of Artificial Sequence: Synthetic oligonucleotide
  Target: AGXT; (-) strand; PAM type: YTN; PAM sequence: TTT
atttacaaaaagcaggtggc

SEQ ID NO: 14247 - DNA, 20 bp, Artificial Sequence
  Description of Artificial Sequence: Synthetic oligonucleotide
  Target: AGXT; (-) strand; PAM type: YTN; PAM sequence: CTT
tatttacaaaaagcaggtgg

SEQ ID NO: 14248 - DNA, 20 bp, Artificial Sequence
  Description of Artificial Sequence: Synthetic oligonucleotide
  Target: AGXT; (-) strand; PAM type: YTN; PAM sequence: CTA
taaaactttatttacaaaaa

SEQ ID NO: 14249 - DNA, 20 bp, Artificial Sequence
  Description of Artificial Sequence: Synthetic oligonucleotide
  Target: AGXT; (-) strand; PAM type: YTN; PAM sequence: TTC
ctataaaactttatttacaa

SEQ ID NO: 14250 - DNA, 20 bp, Artificial Sequence
  Description of Artificial Sequence: Synthetic oligonucleotide
  Target: AGXT; (-) strand; PAM type: YTN; PAM sequence: CTG
ccagaggtgtgggcgtgttc

SEQ ID NO: 14251 - DNA, 20 bp, Artificial Sequence
  Description of Artificial Sequence: Synthetic oligonucleotide
  Target: AGXT; (-) strand; PAM type: YTN; PAM sequence: TTG
caaagcagctgccagaggtg

SEQ ID NO: 14252 - DNA, 20 bp, Artificial Sequence
  Description of Artificial Sequence: Synthetic oligonucleotide
  Target: AGXT; (-) strand; PAM type: YTN; PAM sequence: CTT
gcaaagcagctgccagaggt

SEQ ID NO: 14253 - DNA, 20 bp, Artificial Sequence
  Description of Artificial Sequence: Synthetic oligonucleotide
  Target: AGXT; (-) strand; PAM type: YTN; PAM sequence: CTG
cgtgcttgcaaagcagctgc

SEQ ID NO: 14254 - DNA, 20 bp, Artificial Sequence
  Description of Artificial Sequence: Synthetic oligonucleotide
  Target: AGXT; (-) strand; PAM type: YTN; PAM sequence: CTG
ctgcgtgcttgcaaagcagc

SEQ ID NO: 14255 - DNA, 20 bp, Artificial Sequence
  Description of Artificial Sequence: Synthetic oligonucleotide
  Target: AGXT; (-) strand; PAM type: YTN; PAM sequence: CTC
aaccctgctgcgtgcttgca

SEQ ID NO: 14256 - DNA, 20 bp, Artificial Sequence
  Description of Artificial Sequence: Synthetic oligonucleotide
  Target: AGXT; (-) strand; PAM type: YTN; PAM sequence: TTG
caacaactcaaccctgctgc

SEQ ID NO: 14257 - DNA, 20 bp, Artificial Sequence
  Description of Artificial Sequence: Synthetic oligonucleotide
  Target: AGXT; (-) strand; PAM type: YTN; PAM sequence: CTA
tgttgcaacaactcaaccct

SEQ ID NO: 14258 - DNA, 20 bp, Artificial Sequence
  Description of Artificial Sequence: Synthetic oligonucleotide
  Target: AGXT; (-) strand; PAM type: YTN; PAM sequence: CTG
tggtctatgttgcaacaact

SEQ ID NO: 14259 - DNA, 20 bp, Artificial Sequence
  Description of Artificial Sequence: Synthetic oligonucleotide
  Target: AGXT; (-) strand; PAM type: YTN; PAM sequence: TTG
gcaggccctgtggtctatgt

SEQ ID NO: 14260 - DNA, 20 bp, Artificial Sequence
  Description of Artificial Sequence: Synthetic oligonucleotide
  Target: AGXT; (-) strand; PAM type: YTN; PAM sequence: CTT
ggcaggccctgtggtctatg

SEQ ID NO: 14261 - DNA, 20 bp, Artificial Sequence
  Description of Artificial Sequence: Synthetic oligonucleotide
  Target: AGXT; (-) strand; PAM type: YTN; PAM sequence: TTG
aggcttggcaggccctgtgg

SEQ ID NO: 14262 - DNA, 20 bp, Artificial Sequence
  Description of Artificial Sequence: Synthetic oligonucleotide
  Target: AGXT; (-) strand; PAM type: YTN; PAM sequence: TTA
aagggtcggagcacagataa

SEQ ID NO: 14263 - DNA, 20 bp, Artificial Sequence
  Description of Artificial Sequence: Synthetic oligonucleotide
  Target: AGXT; (-) strand; PAM type: YTN; PAM sequence: CTT
aaagggtcggagcacagata

SEQ ID NO: 14264 - DNA, 20 bp, Artificial Sequence
  Description of Artificial Sequence: Synthetic oligonucleotide
  Target: AGXT; (-) strand; PAM type: YTN; PAM sequence: TTC
ttaaagggtcggagcacaga

SEQ ID NO: 14265 - DNA, 20 bp, Artificial Sequence
  Description of Artificial Sequence: Synthetic oligonucleotide
  Target: AGXT; (-) strand; PAM type: YTN; PAM sequence: TTT
cttaaagggtcggagcacag

SEQ ID NO: 14266 - DNA, 20 bp, Artificial Sequence
  Description of Artificial Sequence: Synthetic oligonucleotide
  Target: AGXT; (-) strand; PAM type: YTN; PAM sequence: CTC
aggggtgagagaagtgtttc

SEQ ID NO: 14267 - DNA, 20 bp, Artificial Sequence
  Description of Artificial Sequence: Synthetic oligonucleotide
  Target: AGXT; (-) strand; PAM type: YTN; PAM sequence: TTA
gctcaggggtgagagaagtg

SEQ ID NO: 14268 - DNA, 20 bp, Artificial Sequence
  Description of Artificial Sequence: Synthetic oligonucleotide
  Target: AGXT; (-) strand; PAM type: YTN; PAM sequence: CTT
agctcaggggtgagagaagt

SEQ ID NO: 14269 - DNA, 20 bp, Artificial Sequence
  Description of Artificial Sequence: Synthetic oligonucleotide
  Target: AGXT; (-) strand; PAM type: YTN; PAM sequence: CTG
cttagctcaggggtgagaga

SEQ ID NO: 14270 - DNA, 20 bp, Artificial Sequence
  Description of Artificial Sequence: Synthetic oligonucleotide
  Target: AGXT; (-) strand; PAM type: YTN; PAM sequence: TTC
tgcttagctcaggggtgaga

SEQ ID NO: 14271 - DNA, 20 bp, Artificial Sequence
  Description of Artificial Sequence: Synthetic oligonucleotide
  Target: AGXT; (-) strand; PAM type: YTN; PAM sequence: TTA
ttctgcttagctcaggggtg

SEQ ID NO: 14272 - DNA, 20 bp, Artificial Sequence
  Description of Artificial Sequence: Synthetic oligonucleotide
  Target: AGXT; (-) strand; PAM type: YTN; PAM sequence: CTT
attctgcttagctcaggggt

SEQ ID NO: 14273 - DNA, 20 bp, Artificial Sequence
  Description of Artificial Sequence: Synthetic oligonucleotide
  Target: AGXT; (-) strand; PAM type: YTN; PAM sequence: CTC
ttattctgcttagctcaggg

SEQ ID NO: 14274 - DNA, 20 bp, Artificial Sequence
  Description of Artificial Sequence: Synthetic oligonucleotide
  Target: AGXT; (-) strand; PAM type: YTN; PAM sequence: CTG
cacgtccagcccctcttatt

SEQ ID NO: 14275 - DNA, 20 bp, Artificial Sequence
  Description of Artificial Sequence: Synthetic oligonucleotide
  Target: AGXT; (-) strand; PAM type: YTN; PAM sequence: CTG
agtcctgcacgtccagcccc

SEQ ID NO: 14276 - DNA, 20 bp, Artificial Sequence
  Description of Artificial Sequence: Synthetic oligonucleotide
  Target: AGXT; (-) strand; PAM type: YTN; PAM sequence: CTC
tgagtcctgcacgtccagcc

SEQ ID NO: 14277 - DNA, 20 bp, Artificial Sequence
  Description of Artificial Sequence: Synthetic oligonucleotide
  Target: AGXT; (-) strand; PAM type: YTN; PAM sequence: CTC
ccactctgagtcctgcacgt

SEQ ID NO: 14278 - DNA, 20 bp, Artificial Sequence
  Description of Artificial Sequence: Synthetic oligonucleotide
  Target: AGXT; (-) strand; PAM type: YTN; PAM sequence: CTC
gctcccactctgagtcctgc

SEQ ID NO: 14279 - DNA, 20 bp, Artificial Sequence
  Description of Artificial Sequence: Synthetic oligonucleotide
  Target: AGXT; (-) strand; PAM type: YTN; PAM sequence: CTC
ctcgctcccactctgagtcc

SEQ ID NO: 14280 - DNA, 20 bp, Artificial Sequence
  Description of Artificial Sequence: Synthetic oligonucleotide
  Target: AGXT; (-) strand; PAM type: YTN; PAM sequence: CTC
accccagccctcctcgctcc

SEQ ID NO: 14281 - DNA, 20 bp, Artificial Sequence
  Description of Artificial Sequence: Synthetic oligonucleotide
  Target: AGXT; (-) strand; PAM type: YTN; PAM sequence: CTG
tcctcaccccagccctcctc

SEQ ID NO: 14282 - DNA, 20 bp, Artificial Sequence
  Description of Artificial Sequence: Synthetic oligonucleotide
  Target: AGXT; (-) strand; PAM type: YTN; PAM sequence: CTG
agtgacagaaaaacagagtg

SEQ ID NO: 14283 - DNA, 20 bp, Artificial Sequence
  Description of Artificial Sequence: Synthetic oligonucleotide
  Target: AGXT; (-) strand; PAM type: YTN; PAM sequence: CTC
aggcagagggagcccccagg

SEQ ID NO: 14284 - DNA, 20 bp, Artificial Sequence
  Description of Artificial Sequence: Synthetic oligonucleotide
  Target: AGXT; (-) strand; PAM type: YTN; PAM sequence: CTG
cgggtcacggccaggcagca

SEQ ID NO: 14285 - DNA, 20 bp, Artificial Sequence
  Description of Artificial Sequence: Synthetic oligonucleotide
  Target: AGXT; (-) strand; PAM type: YTN; PAM sequence: TTG
tgctgcgggtcacggccagg

SEQ ID NO: 14286 - DNA, 20 bp, Artificial Sequence
  Description of Artificial Sequence: Synthetic oligonucleotide
  Target: AGXT; (-) strand; PAM type: YTN; PAM sequence: CTT
gtgctgcgggtcacggccag

SEQ ID NO: 14287 - DNA, 20 bp, Artificial Sequence
  Description of Artificial Sequence: Synthetic oligonucleotide
  Target: AGXT; (-) strand; PAM type: YTN; PAM sequence: CTG
tgcttgtgctgcgggtcacg

SEQ ID NO: 14288 - DNA, 20 bp, Artificial Sequence
  Description of Artificial Sequence: Synthetic oligonucleotide
  Target: AGXT; (-) strand; PAM type: YTN; PAM sequence: TTA
tctgtgcttgtgctgcgggt

SEQ ID NO: 14289 - DNA, 20 bp, Artificial Sequence
  Description of Artificial Sequence: Synthetic oligonucleotide
  Target: AGXT; (-) strand; PAM type: YTN; PAM sequence: CTT
atctgtgcttgtgctgcggg

SEQ ID NO: 14290 - DNA, 20 bp, Artificial Sequence
  Description of Artificial Sequence: Synthetic oligonucleotide
  Target: AGXT; (-) strand; PAM type: YTN; PAM sequence: CTG
aggcttatctgtgcttgtgc

SEQ ID NO: 14291 - DNA, 20 bp, Artificial Sequence
  Description of Artificial Sequence: Synthetic oligonucleotide
  Target: AGXT; (-) strand; PAM type: YTN; PAM sequence: TTC
cctgaggcttatctgtgctt

SEQ ID NO: 14292 - DNA, 20 bp, Artificial Sequence
  Description of Artificial Sequence: Synthetic oligonucleotide
  Target: AGXT; (-) strand; PAM type: YTN; PAM sequence: TTG
ttccctgaggcttatctgtg

SEQ ID NO: 14293 - DNA, 20 bp, Artificial Sequence
  Description of Artificial Sequence: Synthetic oligonucleotide
  Target: AGXT; (-) strand; PAM type: YTN; PAM sequence: TTT
gttccctgaggcttatctgt

SEQ ID NO: 14294 - DNA, 20 bp, Artificial Sequence
  Description of Artificial Sequence: Synthetic oligonucleotide
  Target: AGXT; (-) strand; PAM type: YTN; PAM sequence: TTT
tgttccctgaggcttatctg

SEQ ID NO: 14295 - DNA, 20 bp, Artificial Sequence
  Description of Artificial Sequence: Synthetic oligonucleotide
  Target: AGXT; (-) strand; PAM type: YTN; PAM sequence: CTT
ttgttccctgaggcttatct

SEQ ID NO: 14296 - DNA, 20 bp, Artificial Sequence
  Description of Artificial Sequence: Synthetic oligonucleotide
  Target: AGXT; (-) strand; PAM type: YTN; PAM sequence: CTG
ccttttgttccctgaggctt

SEQ ID NO: 14297 - DNA, 20 bp, Artificial Sequence
  Description of Artificial Sequence: Synthetic oligonucleotide
  Target: AGXT; (-) strand; PAM type: YTN; PAM sequence: TTC
cgtggcagccctgccttttg

SEQ ID NO: 14298 - DNA, 20 bp, Artificial Sequence
  Description of Artificial Sequence: Synthetic oligonucleotide
  Target: AGXT; (-) strand; PAM type: YTN; PAM sequence: CTT
ccgtggcagccctgcctttt

SEQ ID NO: 14299 - DNA, 20 bp, Artificial Sequence
  Description of Artificial Sequence: Synthetic oligonucleotide
  Target: AGXT; (-) strand; PAM type: YTN; PAM sequence: TTG
gtggatgggcttccgtggca

SEQ ID NO: 14300 - DNA, 20 bp, Artificial Sequence
  Description of Artificial Sequence: Synthetic oligonucleotide
  Target: AGXT; (-) strand; PAM type: YTN; PAM sequence: TTC
ccagcagggcggacacagag

SEQ ID NO: 14301 - DNA, 20 bp, Artificial Sequence
  Description of Artificial Sequence: Synthetic oligonucleotide
  Target: AGXT; (-) strand; PAM type: YTN; PAM sequence: TTT
cccagcagggcggacacaga

SEQ ID NO: 14302 - DNA, 20 bp, Artificial Sequence
  Description of Artificial Sequence: Synthetic oligonucleotide
  Target: AGXT; (-) strand; PAM type: YTN; PAM sequence: CTG
gaatatttcccagcagggcg

SEQ ID NO: 14303 - DNA, 20 bp, Artificial Sequence
  Description of Artificial Sequence: Synthetic oligonucleotide
  Target: AGXT; (-) strand; PAM type: YTN; PAM sequence: TTG
gccaaagcctggaatatttc

SEQ ID NO: 14304 - DNA, 20 bp, Artificial Sequence
  Description of Artificial Sequence: Synthetic oligonucleotide
  Target: AGXT; (-) strand; PAM type: YTN; PAM sequence: CTT
ggccaaagcctggaatattt

SEQ ID NO: 14305 - DNA, 20 bp, Artificial Sequence
  Description of Artificial Sequence: Synthetic oligonucleotide
  Target: AGXT; (-) strand; PAM type: YTN; PAM sequence: CTG
gccttggccaaagcctggaa

SEQ ID NO: 14306 - DNA, 20 bp, Artificial Sequence
  Description of Artificial Sequence: Synthetic oligonucleotide
  Target: AGXT; (-) strand; PAM type: YTN; PAM sequence: CTG
cactggccttggccaaagcc

SEQ ID NO: 14307 - DNA, 20 bp, Artificial Sequence
  Description of Artificial Sequence: Synthetic oligonucleotide
  Target: AGXT; (-) strand; PAM type: YTN; PAM sequence: CTG
gggctgcactggccttggcc

SEQ ID NO: 14308 - DNA, 20 bp, Artificial Sequence
  Description of Artificial Sequence: Synthetic oligonucleotide
  Target: AGXT; (-) strand; PAM type: YTN; PAM sequence: CTC
gggaacctggggctgcactg

SEQ ID NO: 14309 - DNA, 20 bp, Artificial Sequence
  Description of Artificial Sequence: Synthetic oligonucleotide
  Target: AGXT; (-) strand; PAM type: YTN; PAM sequence: CTG
ccgctcgggaacctggggct

SEQ ID NO: 14310 - DNA, 20 bp, Artificial Sequence
  Description of Artificial Sequence: Synthetic oligonucleotide
  Target: AGXT; (-) strand; PAM type: YTN; PAM sequence: TTG
tgagaggccatggtccgcac

SEQ ID NO: 14311 - DNA, 20 bp, Artificial Sequence
  Description of Artificial Sequence: Synthetic oligonucleotide
  Target: AGXT; (-) strand; PAM type: YTN; PAM sequence: CTT
gtgagaggccatggtccgca

SEQ ID NO: 14312 - DNA, 20 bp, Artificial Sequence
  Description of Artificial Sequence: Synthetic oligonucleotide
  Target: AGXT; (-) strand; PAM type: YTN; PAM sequence: TTG
gggggggtcaccagcagctt

SEQ ID NO: 14313 - DNA, 20 bp, Artificial Sequence
  Description of Artificial Sequence: Synthetic oligonucleotide
  Target: AGXT; (-) strand; PAM type: YTN; PAM sequence: CTT
ggggggggtcaccagcagct

SEQ ID NO: 14314 - DNA, 20 bp, Artificial Sequence
  Description of Artificial Sequence: Synthetic oligonucleotide
  Target: AGXT; (-) strand; PAM type: YTN; PAM sequence: TTG
agcagggccttggggggggt

SEQ ID NO: 14315 - DNA, 20 bp, Artificial Sequence
  Description of Artificial Sequence: Synthetic oligonucleotide
  Target: AGXT; (-) strand; PAM type: YTN; PAM sequence: CTT
gagcagggccttgggggggg

SEQ ID NO: 14316 - DNA, 20 bp, Artificial Sequence
  Description of Artificial Sequence: Synthetic oligonucleotide
  Target: AGXT; (-) strand; PAM type: YTN; PAM sequence: TTG
gggatggagaggggcttgag

SEQ ID NO: 14317 - DNA, 20 bp, Artificial Sequence
  Description of Artificial Sequence: Synthetic oligonucleotide
  Target: AGXT; (-) strand; PAM type: YTN; PAM sequence: CTG
gttggggatggagaggggct

SEQ ID NO: 14318 - DNA, 20 bp, Artificial Sequence
  Description of Artificial Sequence: Synthetic oligonucleotide
  Target: AGXT; (-) strand; PAM type: YTN; PAM sequence: TTG
gaaggaccaggccccagcag

SEQ ID NO: 14319 - DNA, 20 bp, Artificial Sequence
  Description of Artificial Sequence: Synthetic oligonucleotide
  Target: AGXT; (-) strand; PAM type: YTN; PAM sequence: CTG
ccatgatgcgaggaggcagg

SEQ ID NO: 14320 - DNA, 20 bp, Artificial Sequence
  Description of Artificial Sequence: Synthetic oligonucleotide
  Target: AGXT; (-) strand; PAM type: YTN; PAM sequence: CTG
cagccccccggctgccatga

SEQ ID NO: 14321 - DNA, 20 bp, Artificial Sequence
  Description of Artificial Sequence: Synthetic oligonucleotide
  Target: AGXT; (-) strand; PAM type: YTN; PAM sequence: CTC
atggacccgatcatctgcag

SEQ ID NO: 14322 - DNA, 20 bp, Artificial Sequence
  Description of Artificial Sequence: Synthetic oligonucleotide
  Target: AGXT; (-) strand; PAM type: YTN; PAM sequence: TTG
ctcatggacccgatcatctg

SEQ ID NO: 14323 - DNA, 20 bp, Artificial Sequence
  Description of Artificial Sequence: Synthetic oligonucleotide
  Target: AGXT; (-) strand; PAM type: YTN; PAM sequence: CTT
gctcatggacccgatcatct

SEQ ID NO: 14324 - DNA, 20 bp, Artificial Sequence
  Description of Artificial Sequence: Synthetic oligonucleotide
  Target: AGXT; (-) strand; PAM type: YTN; PAM sequence: CTG
gtacatatccttgctcatgg

SEQ ID NO: 14325 - DNA, 20 bp, Artificial Sequence
  Description of Artificial Sequence: Synthetic oligonucleotide
  Target: AGXT; (-) strand; PAM type: YTN; PAM sequence: CTA
cctggtacatatccttgctc

SEQ ID NO: 14326 - DNA, 20 bp, Artificial Sequence
  Description of Artificial Sequence: Synthetic oligonucleotide
  Target: AGXT; (-) strand; PAM type: YTN; PAM sequence: CTC
ctacctggtacatatccttg

SEQ ID NO: 14327 - DNA, 20 bp, Artificial Sequence
  Description of Artificial Sequence: Synthetic oligonucleotide
  Target: AGXT; (-) strand; PAM type: YTN; PAM sequence: CTG
tgggtgggaacatgggtgag

SEQ ID NO: 14328 - DNA, 20 bp, Artificial Sequence
  Description of Artificial Sequence: Synthetic oligonucleotide
  Target: AGXT; (-) strand; PAM type: YTN; PAM sequence: CTC
gtccacgatctgtgggtggg

SEQ ID NO: 14329 - DNA, 20 bp, Artificial Sequence
  Description of Artificial Sequence: Synthetic oligonucleotide
  Target: AGXT; (-) strand; PAM type: YTN; PAM sequence: TTC
cctcgtccacgatctgtggg

SEQ ID NO: 14330 - DNA, 20 bp, Artificial Sequence
  Description of Artificial Sequence: Synthetic oligonucleotide
  Target: AGXT; (-) strand; PAM type: YTN; PAM sequence: CTT
ccctcgtccacgatctgtgg

SEQ ID NO: 14331 - DNA, 20 bp, Artificial Sequence
  Description of Artificial Sequence: Synthetic oligonucleotide
  Target: AGXT; (-) strand; PAM type: YTN; PAM sequence: CTC
cccaagtgaggaggcagtga

SEQ ID NO: 14332 - DNA, 20 bp, Artificial Sequence
  Description of Artificial Sequence: Synthetic oligonucleotide
  Target: AGXT; (-) strand; PAM type: YTN; PAM sequence: CTC
cccgcctccccaagtgagga

SEQ ID NO: 14333 - DNA, 20 bp, Artificial Sequence
  Description of Artificial Sequence: Synthetic oligonucleotide
  Target: AGXT; (-) strand; PAM type: YTN; PAM sequence: CTG
catgcgggtggtatagggtg

SEQ ID NO: 14334 - DNA, 20 bp, Artificial Sequence
  Description of Artificial Sequence: Synthetic oligonucleotide
  Target: AGXT; (-) strand; PAM type: YTN; PAM sequence: CTC
gtccatgatctgcatgcggg

SEQ ID NO: 14335 - DNA, 20 bp, Artificial Sequence
  Description of Artificial Sequence: Synthetic oligonucleotide
  Target: AGXT; (-) strand; PAM type: YTN; PAM sequence: TTG
atctcgtccatgatctgcat

SEQ ID NO: 14336 - DNA, 20 bp, Artificial Sequence
  Description of Artificial Sequence: Synthetic oligonucleotide
  Target: AGXT; (-) strand; PAM type: YTN; PAM sequence: CTT
gatctcgtccatgatctgca

SEQ ID NO: 14337 - DNA, 20 bp, Artificial Sequence
  Description of Artificial Sequence: Synthetic oligonucleotide
  Target: AGXT; (-) strand; PAM type: YTN; PAM sequence: TTC
cttgatctcgtccatgatct

SEQ ID NO: 14338 - DNA, 20 bp, Artificial Sequence
  Description of Artificial Sequence: Synthetic oligonucleotide
  Target: AGXT; (-) strand; PAM type: YTN; PAM sequence: CTT
ccttgatctcgtccatgatc

SEQ ID NO: 14339 - DNA, 20 bp, Artificial Sequence
  Description of Artificial Sequence: Synthetic oligonucleotide
  Target: AGXT; (-) strand; PAM type: YTN; PAM sequence: CTG
gatgccttccttgatctcgt

SEQ ID NO: 14340 - DNA, 20 bp, Artificial Sequence
  Description of Artificial Sequence: Synthetic oligonucleotide
  Target: AGXT; (-) strand; PAM type: YTN; PAM sequence: CTG
gaacacgtactggatgcctt

SEQ ID NO: 14341 - DNA, 20 bp, Artificial Sequence
  Description of Artificial Sequence: Synthetic oligonucleotide
  Target: AGXT; (-) strand; PAM type: YTN; PAM sequence: CTG
gtctggaacacgtactggat

SEQ ID NO: 14342 - DNA, 20 bp, Artificial Sequence
  Description of Artificial Sequence: Synthetic oligonucleotide
  Target: AGXT; (-) strand; PAM type: YTN; PAM sequence: TTC
ctggtctggaacacgtactg

SEQ ID NO: 14343 - DNA, 20 bp, Artificial Sequence
  Description of Artificial Sequence: Synthetic oligonucleotide
  Target: AGXT; (-) strand; PAM type: YTN; PAM sequence: CTC
cagggcacagtgtcccgagc

SEQ ID NO: 14344 - DNA, 20 bp, Artificial Sequence
  Description of Artificial Sequence: Synthetic oligonucleotide
  Target: AGXT; (-) strand; PAM type: YTN; PAM sequence: TTG
accagggcggcctccagggc

SEQ ID NO: 14345 - DNA, 20 bp, Artificial Sequence
  Description of Artificial Sequence: Synthetic oligonucleotide
  Target: AGXT; (-) strand; PAM type: YTN; PAM sequence: CTC
cagcacattgaccagggcgg

SEQ ID NO: 14346 - DNA, 20 bp, Artificial Sequence
  Description of Artificial Sequence: Synthetic oligonucleotide
  Target: AGXT; (-) strand; PAM type: YTN; PAM sequence: TTG
gccccaaccaggaaggagtc

SEQ ID NO: 14347 - DNA, 20 bp, Artificial Sequence
  Description of Artificial Sequence: Synthetic oligonucleotide
  Target: AGXT; (-) strand; PAM type: YTN; PAM sequence: CTG
cccccaaatgccattggccc

SEQ ID NO: 14348 - DNA, 20 bp, Artificial Sequence
  Description of Artificial Sequence: Synthetic oligonucleotide
  Target: AGXT; (-) strand; PAM type: YTN; PAM sequence: CTC
gctgcccccaaatgccattg

SEQ ID NO: 14349 - DNA, 20 bp, Artificial Sequence
  Description of Artificial Sequence: Synthetic oligonucleotide
  Target: AGXT; (-) strand; PAM type: YTN; PAM sequence: CTC
cccgatgtccacggctcgct

SEQ ID NO: 14350 - DNA, 20 bp, Artificial Sequence
  Description of Artificial Sequence: Synthetic oligonucleotide
  Target: AGXT; (-) strand; PAM type: YTN; PAM sequence: CTA
tgcgctccccgatgtccacg

SEQ ID NO: 14351 - DNA, 20 bp, Artificial Sequence
  Description of Artificial Sequence: Synthetic oligonucleotide
  Target: AGXT; (-) strand; PAM type: YTN; PAM sequence: TTA
cctatgcgctccccgatgtc

SEQ ID NO: 14352 - DNA, 20 bp, Artificial Sequence
  Description of Artificial Sequence: Synthetic oligonucleotide
  Target: AGXT; (-) strand; PAM type: YTN; PAM sequence: CTT
acctatgcgctccccgatgt

SEQ ID NO: 14353 - DNA, 20 bp, Artificial Sequence
  Description of Artificial Sequence: Synthetic oligonucleotide
  Target: AGXT; (-) strand; PAM type: YTN; PAM sequence: CTC
ccttacctatgcgctccccg

SEQ ID NO: 14354 - DNA, 20 bp, Artificial Sequence
  Description of Artificial Sequence: Synthetic oligonucleotide
  Target: AGXT; (-) strand; PAM type: YTN; PAM sequence: CTC
tcccttacctatgcgctccc

SEQ ID NO: 14355 - DNA, 20 bp, Artificial Sequence
  Description of Artificial Sequence: Synthetic oligonucleotide
  Target: AGXT; (-) strand; PAM type: YTN; PAM sequence: CTG
ggcctctcccttacctatgc

SEQ ID NO: 14356 - DNA, 20 bp, Artificial Sequence
  Description of Artificial Sequence: Synthetic oligonucleotide
  Target: AGXT; (-) strand; PAM type: YTN; PAM sequence: TTG
aaggatggatccagggccat

SEQ ID NO: 14357 - DNA, 20 bp, Artificial Sequence
  Description of Artificial Sequence: Synthetic oligonucleotide
  Target: AGXT; (-) strand; PAM type: YTN; PAM sequence: CTT
gaaggatggatccagggcca

SEQ ID NO: 14358 - DNA, 20 bp, Artificial Sequence
  Description of Artificial Sequence: Synthetic oligonucleotide
  Target: AGXT; (-) strand; PAM type: YTN; PAM sequence: TTC
aaacagagggaggccaggga

SEQ ID NO: 14359 - DNA, 20 bp, Artificial Sequence
  Description of Artificial Sequence: Synthetic oligonucleotide
  Target: AGXT; (-) strand; PAM type: YTN; PAM sequence: CTT
caaacagagggaggccaggg

SEQ ID NO: 14360 - DNA, 20 bp, Artificial Sequence
  Description of Artificial Sequence: Synthetic oligonucleotide
  Target: AGXT; (-) strand; PAM type: YTN; PAM sequence: CTG
ccagcttcaaacagagggag

SEQ ID NO: 14361 - DNA, 20 bp, Artificial Sequence
  Description of Artificial Sequence: Synthetic oligonucleotide
  Target: AGXT; (-) strand; PAM type: YTN; PAM sequence: CTC
acccaggaacgggggctgcc

SEQ ID NO: 14362 - DNA, 20 bp, Artificial Sequence
  Description of Artificial Sequence: Synthetic oligonucleotide
  Target: AGXT; (-) strand; PAM type: YTN; PAM sequence: TTC
gtgcgcacagggccacaagg

SEQ ID NO: 14363 - DNA, 20 bp, Artificial Sequence
  Description of Artificial Sequence: Synthetic oligonucleotide
  Target: AGXT; (-) strand; PAM type: YTN; PAM sequence: CTG
gcaggaggttcgtgcgcaca

SEQ ID NO: 14364 - DNA, 20 bp, Artificial Sequence
  Description of Artificial Sequence: Synthetic oligonucleotide
  Target: AGXT; (-) strand; PAM type: YTN; PAM sequence: CTG
gaggaggcagtgggctggca

SEQ ID NO: 14365 - DNA, 20 bp, Artificial Sequence
  Description of Artificial Sequence: Synthetic oligonucleotide
  Target: AGXT; (-) strand; PAM type: YTN; PAM sequence: CTC
atgagtgcccgacaccgcct

SEQ ID NO: 14366 - DNA, 20 bp, Artificial Sequence
  Description of Artificial Sequence: Synthetic oligonucleotide
  Target: AGXT; (-) strand; PAM type: YTN; PAM sequence: CTA
tcagagtcaggcctcatgag

SEQ ID NO: 14367 - DNA, 20 bp, Artificial Sequence
  Description of Artificial Sequence: Synthetic oligonucleotide
  Target: AGXT; (-) strand; PAM type: YTN; PAM sequence: CTC
ccagccctatcagagtcagg

SEQ ID NO: 14368 - DNA, 20 bp, Artificial Sequence
  Description of Artificial Sequence: Synthetic oligonucleotide
  Target: AGXT; (-) strand; PAM type: YTN; PAM sequence: CTG
ctcccagccctatcagagtc

SEQ ID NO: 14369 - DNA, 20 bp, Artificial Sequence
  Description of Artificial Sequence: Synthetic oligonucleotide
  Target: AGXT; (-) strand; PAM type: YTN; PAM sequence: CTG
tgctgctcccagccctatca

SEQ ID NO: 14370 - DNA, 20 bp, Artificial Sequence
  Description of Artificial Sequence: Synthetic oligonucleotide
  Target: AGXT; (-) strand; PAM type: YTN; PAM sequence: CTG
gggggatcggggcacctgtg

SEQ ID NO: 14371 - DNA, 20 bp, Artificial Sequence
  Description of Artificial Sequence: Synthetic oligonucleotide
  Target: AGXT; (-) strand; PAM type: YTN; PAM sequence: CTC
aaggagactggggggatcgg

SEQ ID NO: 14372 - DNA, 20 bp, Artificial Sequence
  Description of Artificial Sequence: Synthetic oligonucleotide
  Target: AGXT; (-) strand; PAM type: YTN; PAM sequence: CTC
cagaaacagctcaaggagac

SEQ ID NO: 14373 - DNA, 20 bp, Artificial Sequence
  Description of Artificial Sequence: Synthetic oligonucleotide
  Target: AGXT; (-) strand; PAM type: YTN; PAM sequence: CTG
cacatgctccagaaacagct

SEQ ID NO: 14374 - DNA, 20 bp, Artificial Sequence
  Description of Artificial Sequence: Synthetic oligonucleotide
  Target: AGXT; (-) strand; PAM type: YTN; PAM sequence: TTC
cgtcctgcacatgctccaga

SEQ ID NO: 14375 - DNA, 20 bp, Artificial Sequence
  Description of Artificial Sequence: Synthetic oligonucleotide
  Target: AGXT; (-) strand; PAM type: YTN; PAM sequence: CTG
tagttccgtcctgcacatgc

SEQ ID NO: 14376 - DNA, 20 bp, Artificial Sequence
  Description of Artificial Sequence: Synthetic oligonucleotide
  Target: AGXT; (-) strand; PAM type: YTN; PAM sequence: TTC
cctgtagttccgtcctgcac

SEQ ID NO: 14377 - DNA, 20 bp, Artificial Sequence
  Description of Artificial Sequence: Synthetic oligonucleotide
  Target: AGXT; (-) strand; PAM type: YTN; PAM sequence: CTT
ccctgtagttccgtcctgca

SEQ ID NO: 14378 - DNA, 20 bp, Artificial Sequence
  Description of Artificial Sequence: Synthetic oligonucleotide
  Target: AGXT; (-) strand; PAM type: YTN; PAM sequence: CTG
ggaccagaggcttccctgta

SEQ ID NO: 14379 - DNA, 20 bp, Artificial Sequence
  Description of Artificial Sequence: Synthetic oligonucleotide
  Target: AGXT; (-) strand; PAM type: YTN; PAM sequence: CTC
aggagtgtgtgctgggacca

SEQ ID NO: 14380 - DNA, 20 bp, Artificial Sequence
  Description of Artificial Sequence: Synthetic oligonucleotide
  Target: AGXT; (-) strand; PAM type: YTN; PAM sequence: CTC
tcaggagtgtgtgctgggac

SEQ ID NO: 14381 - DNA, 20 bp, Artificial Sequence
  Description of Artificial Sequence: Synthetic oligonucleotide
  Target: AGXT; (-) strand; PAM type: YTN; PAM sequence: CTG
gacagcggccggggctctca

SEQ ID NO: 14382 - DNA, 20 bp, Artificial Sequence
  Description of Artificial Sequence: Synthetic oligonucleotide
  Target: AGXT; (-) strand; PAM type: YTN; PAM sequence: CTG
gggccctggacagcggccgg

SEQ ID NO: 14383 - DNA, 20 bp, Artificial Sequence
  Description of Artificial Sequence: Synthetic oligonucleotide
  Target: AGXT; (-) strand; PAM type: YTN; PAM sequence: CTG
gtgcctggggccctggacag

SEQ ID NO: 14384 - DNA, 20 bp, Artificial Sequence
  Description of Artificial Sequence: Synthetic oligonucleotide
  Target: AGXT; (-) strand; PAM type: YTN; PAM sequence: CTG
tcacaaagcagagctggtgc

SEQ ID NO: 14385 - DNA, 20 bp, Artificial Sequence
  Description of Artificial Sequence: Synthetic oligonucleotide
  Target: AGXT; (-) strand; PAM type: YTN; PAM sequence: CTG
aaaccccaccctgtcacaaa

SEQ ID NO: 14386 - DNA, 20 bp, Artificial Sequence
  Description of Artificial Sequence: Synthetic oligonucleotide
  Target: AGXT; (-) strand; PAM type: YTN; PAM sequence: TTC
tgaaaccccaccctgtcaca

SEQ ID NO: 14387 - DNA, 20 bp, Artificial Sequence
  Description of Artificial Sequence: Synthetic oligonucleotide
  Target: AGXT; (-) strand; PAM type: YTN; PAM sequence: CTT
ctgaaaccccaccctgtcac

SEQ ID NO: 14388 - DNA, 20 bp, Artificial Sequence
  Description of Artificial Sequence: Synthetic oligonucleotide
  Target: AGXT; (-) strand; PAM type: YTN; PAM sequence: TTC
agcttctgaaaccccaccct

SEQ ID NO: 14389 - DNA, 20 bp, Artificial Sequence
  Description of Artificial Sequence: Synthetic oligonucleotide
  Target: AGXT; (-) strand; PAM type: YTN; PAM sequence: CTT
cagcttctgaaaccccaccc

SEQ ID NO: 14390 - DNA, 20 bp, Artificial Sequence
  Description of Artificial Sequence: Synthetic oligonucleotide
  Target: AGXT; (-) strand; PAM type: YTN; PAM sequence: TTG
aggggaggcttcagcttctg

SEQ ID NO: 14391 - DNA, 20 bp, Artificial Sequence
  Description of Artificial Sequence: Synthetic oligonucleotide
  Target: AGXT; (-) strand; PAM type: YTN; PAM sequence: TTT
gaggggaggcttcagcttct

SEQ ID NO: 14392 - DNA, 20 bp, Artificial Sequence
  Description of Artificial Sequence: Synthetic oligonucleotide
  Target: AGXT; (-) strand; PAM type: YTN; PAM sequence: CTG
agatttgaggggaggcttca

SEQ ID NO: 14393 - DNA, 20 bp, Artificial Sequence
  Description of Artificial Sequence: Synthetic oligonucleotide
  Target: AGXT; (-) strand; PAM type: YTN; PAM sequence: CTG
ctgagatttgaggggaggct

SEQ ID NO: 14394 - DNA, 20 bp, Artificial Sequence
  Description of Artificial Sequence: Synthetic oligonucleotide
  Target: AGXT; (-) strand; PAM type: YTN; PAM sequence: TTC
cagaaggaaggctgctgaga

SEQ ID NO: 14395 - DNA, 20 bp, Artificial Sequence
  Description of Artificial Sequence: Synthetic oligonucleotide
  Target: AGXT; (-) strand; PAM type: YTN; PAM sequence: TTG
tgtatcacatcaagattcca

SEQ ID NO: 14396 - DNA, 20 bp, Artificial Sequence
  Description of Artificial Sequence: Synthetic oligonucleotide
  Target: AGXT; (-) strand; PAM type: YTN; PAM sequence: TTT
gtgtatcacatcaagattcc

SEQ ID NO: 14397 - DNA, 20 bp, Artificial Sequence
  Description of Artificial Sequence: Synthetic oligonucleotide
  Target: AGXT; (-) strand; PAM type: YTN; PAM sequence: TTT
tgtgtatcacatcaagattc

SEQ ID NO: 14398 - DNA, 20 bp, Artificial Sequence
  Description of Artificial Sequence: Synthetic oligonucleotide
  Target: AGXT; (-) strand; PAM type: YTN; PAM sequence: CTC
catattttgtgtatcacatc

SEQ ID NO: 14399 - DNA, 20 bp, Artificial Sequence
  Description of Artificial Sequence: Synthetic oligonucleotide
  Target: AGXT; (-) strand; PAM type: YTN; PAM sequence: CTG
cccatacctccatattttgt

SEQ ID NO: 14400 - DNA, 20 bp, Artificial Sequence
  Description of Artificial Sequence: Synthetic oligonucleotide
  Target: AGXT; (-) strand; PAM type: YTN; PAM sequence: CTC
tgcccatacctccatatttt

SEQ ID NO: 14401 - DNA, 20 bp, Artificial Sequence
  Description of Artificial Sequence: Synthetic oligonucleotide
  Target: AGXT; (-) strand; PAM type: YTN; PAM sequence: CTC
cggaggcgaatactctgccc

SEQ ID NO: 14402 - DNA, 20 bp, Artificial Sequence
  Description of Artificial Sequence: Synthetic oligonucleotide
  Target: AGXT; (-) strand; PAM type: YTN; PAM sequence: CTC
ccagaaaagtgtactccgga

SEQ ID NO: 14403 - DNA, 20 bp, Artificial Sequence
  Description of Artificial Sequence: Synthetic oligonucleotide
  Target: AGXT; (-) strand; PAM type: YTN; PAM sequence: CTC
tcccagaaaagtgtactccg

SEQ ID NO: 14404 - DNA, 20 bp, Artificial Sequence
  Description of Artificial Sequence: Synthetic oligonucleotide
  Target: AGXT; (-) strand; PAM type: YTN; PAM sequence: CTG
tgtctctcccagaaaagtgt

SEQ ID NO: 14405 - DNA, 20 bp, Artificial Sequence
  Description of Artificial Sequence: Synthetic oligonucleotide
  Target: AGXT; (-) strand; PAM type: YTN; PAM sequence: CTC
ctgtgtctctcccagaaaag

SEQ ID NO: 14406 - DNA, 20 bp, Artificial Sequence
  Description of Artificial Sequence: Synthetic oligonucleotide
  Target: AGXT; (-) strand; PAM type: YTN; PAM sequence: CTG
ctcctgtgtctctcccagaa

SEQ ID NO: 14407 - DNA, 20 bp, Artificial Sequence
  Description of Artificial Sequence: Synthetic oligonucleotide
  Target: AGXT; (-) strand; PAM type: YTN; PAM sequence: CTC
ctgctcctgtgtctctccca

SEQ ID NO: 14408 - DNA, 20 bp, Artificial Sequence
  Description of Artificial Sequence: Synthetic oligonucleotide
  Target: AGXT; (-) strand; PAM type: YTN; PAM sequence: TTA
aacccagggcacactcctgc

SEQ ID NO: 14409 - DNA, 20 bp, Artificial Sequence
  Description of Artificial Sequence: Synthetic oligonucleotide
  Target: AGXT; (-) strand; PAM type: YTN; PAM sequence: CTC
aatgccacaatcaatcatta

SEQ ID NO: 14410 - DNA, 20 bp, Artificial Sequence
  Description of Artificial Sequence: Synthetic oligonucleotide
  Target: AGXT; (-) strand; PAM type: YTN; PAM sequence: CTG
atgtccctcaatgccacaat

SEQ ID NO: 14411 - DNA, 20 bp, Artificial Sequence
  Description of Artificial Sequence: Synthetic oligonucleotide
  Target: AGXT; (-) strand; PAM type: YTN; PAM sequence: CTC
accaagctgatgtccctcaa

SEQ ID NO: 14412 - DNA, 20 bp, Artificial Sequence
  Description of Artificial Sequence: Synthetic oligonucleotide
  Target: AGXT; (-) strand; PAM type: YTN; PAM sequence: TTG
tggagctcaccaagctgatg

SEQ ID NO: 14413 - DNA, 20 bp, Artificial Sequence
  Description of Artificial Sequence: Synthetic oligonucleotide
  Target: AGXT; (-) strand; PAM type: YTN; PAM sequence: TTA
accagcatggccattgtgga

SEQ ID NO: 14414 - DNA, 20 bp, Artificial Sequence
  Description of Artificial Sequence: Synthetic oligonucleotide
  Target: AGXT; (-) strand; PAM type: YTN; PAM sequence: TTG
cggtcgcgtattaaccagca

SEQ ID NO: 14415 - DNA, 20 bp, Artificial Sequence
  Description of Artificial Sequence: Synthetic oligonucleotide
  Target: AGXT; (-) strand; PAM type: YTN; PAM sequence: CTG
ttgcggtcgcgtattaacca

SEQ ID NO: 14416 - DNA, 20 bp, Artificial Sequence
  Description of Artificial Sequence: Synthetic oligonucleotide
  Target: AGXT; (-) strand; PAM type: YTN; PAM sequence: TTG
gctgttgcggtcgcgtatta

SEQ ID NO: 14417 - DNA, 20 bp, Artificial Sequence
  Description of Artificial Sequence: Synthetic oligonucleotide
  Target: AGXT; (-) strand; PAM type: YTN; PAM sequence: CTT
ggctgttgcggtcgcgtatt

SEQ ID NO: 14418 - DNA, 20 bp, Artificial Sequence
  Description of Artificial Sequence: Synthetic oligonucleotide
  Target: AGXT; (-) strand; PAM type: YTN; PAM sequence: CTC
ttggctgttgcggtcgcgta

SEQ ID NO: 14419 - DNA, 20 bp, Artificial Sequence
  Description of Artificial Sequence: Synthetic oligonucleotide
  Target: AGXT; (-) strand; PAM type: YTN; PAM sequence: TTG
ggaccctcttggctgttgcg

SEQ ID NO: 14420 - DNA, 20 bp, Artificial Sequence
  Description of Artificial Sequence: Synthetic oligonucleotide
  Target: AGXT; (-) strand; PAM type: YTN; PAM sequence: TTG
gggttgggaccctcttggct

SEQ ID NO: 14421 - DNA, 20 bp, Artificial Sequence
  Description of Artificial Sequence: Synthetic oligonucleotide
  Target: AGXT; (-) strand; PAM type: YTN; PAM sequence: CTT
ggggttgggaccctcttggc

SEQ ID NO: 14422 - DNA, 20 bp, Artificial Sequence
  Description of Artificial Sequence: Synthetic oligonucleotide
  Target: AGXT; (-) strand; PAM type: YTN; PAM sequence: TTG
tggacttggggttgggaccc

SEQ ID NO: 14423 - DNA, 20 bp, Artificial Sequence
  Description of Artificial Sequence: Synthetic oligonucleotide
  Target: AGXT; (-) strand; PAM type: YTN; PAM sequence: TTT
gtggacttggggttgggacc

SEQ ID NO: 14424 - DNA, 20 bp, Artificial Sequence
  Description of Artificial Sequence: Synthetic oligonucleotide
  Target: AGXT; (-) strand; PAM type: YTN; PAM sequence: TTG
aaaagtttgtggacttgggg

SEQ ID NO: 14425 - DNA, 20 bp, Artificial Sequence
  Description of Artificial Sequence: Synthetic oligonucleotide
  Target: AGXT; (-) strand; PAM type: YTN; PAM sequence: CTT
gaaaagtttgtggacttggg

SEQ ID NO: 14426 - DNA, 20 bp, Artificial Sequence
  Description of Artificial Sequence: Synthetic oligonucleotide
  Target: AGXT; (-) strand; PAM type: YTN; PAM sequence: CTG
ggtccccttgaaaagtttgt

SEQ ID NO: 14427 - DNA, 20 bp, Artificial Sequence
  Description of Artificial Sequence: Synthetic oligonucleotide
  Target: AGXT; (-) strand; PAM type: YTN; PAM sequence: CTG
ccgaccctgggtccccttga

SEQ ID NO: 14428 - DNA, 20 bp, Artificial Sequence
  Description of Artificial Sequence: Synthetic oligonucleotide
  Target: AGXT; (-) strand; PAM type: YTN; PAM sequence: CTC
tgccgaccctgggtcccctt

SEQ ID NO: 14429 - DNA, 20 bp, Artificial Sequence
  Description of Artificial Sequence: Synthetic oligonucleotide
  Target: AGXT; (-) strand; PAM type: YTN; PAM sequence: CTG
gcctctgccgaccctgggtc

SEQ ID NO: 14430 - DNA, 20 bp, Artificial Sequence
  Description of Artificial Sequence: Synthetic oligonucleotide
  Target: AGXT; (-) strand; PAM type: YTN; PAM sequence: TTG
gggtcctggcctctgccgac

SEQ ID NO: 14431 - DNA, 20 bp, Artificial Sequence
  Description of Artificial Sequence: Synthetic oligonucleotide
  Target: AGXT; (-) strand; PAM type: YTN; PAM sequence: CTT
ggggtcctggcctctgccga

SEQ ID NO: 14432 - DNA, 20 bp, Artificial Sequence
  Description of Artificial Sequence: Synthetic oligonucleotide
  Target: AGXT; (-) strand; PAM type: YTN; PAM sequence: CTG
atgtccacttggggtcctgg

SEQ ID NO: 14433 - DNA, 20 bp, Artificial Sequence
  Description of Artificial Sequence: Synthetic oligonucleotide
  Target: AGXT; (-) strand; PAM type: YTN; PAM sequence: CTG
cgtgccctgatgtccacttg

SEQ ID NO: 14434 - DNA, 20 bp, Artificial Sequence
  Description of Artificial Sequence: Synthetic oligonucleotide
  Target: AGXT; (-) strand; PAM type: YTN; PAM sequence: CTG
agcctgcgtgccctgatgtc

SEQ ID NO: 14435 - DNA, 20 bp, Artificial Sequence
  Description of Artificial Sequence: Synthetic oligonucleotide
  Target: AGXT; (-) strand; PAM type: YTN; PAM sequence: CTG
cggccaaggggacagaatgg

SEQ ID NO: 14436 - DNA, 20 bp, Artificial Sequence
  Description of Artificial Sequence: Synthetic oligonucleotide
  Target: AGXT; (-) strand; PAM type: YTN; PAM sequence: TTG
tgggaggggaagaacctgcg

SEQ ID NO: 14437 - DNA, 20 bp, Artificial Sequence
  Description of Artificial Sequence: Synthetic oligonucleotide
  Target: AGXT; (-) strand; PAM type: YTN; PAM sequence: TTC
agggccaggttgtgggaggg

SEQ ID NO: 14438 - DNA, 20 bp, Artificial Sequence
  Description of Artificial Sequence: Synthetic oligonucleotide
  Target: AGXT; (-) strand; PAM type: YTN; PAM sequence: CTG
ttcagggccaggttgtggga

SEQ ID NO: 14439 - DNA, 20 bp, Artificial Sequence
  Description of Artificial Sequence: Synthetic oligonucleotide
  Target: AGXT; (-) strand; PAM type: YTN; PAM sequence: CTG
tgtgctgttcagggccaggt

SEQ ID NO: 14440 - DNA, 20 bp, Artificial Sequence
  Description of Artificial Sequence: Synthetic oligonucleotide
  Target: AGXT; (-) strand; PAM type: YTN; PAM sequence: CTA
tcctgtgtgctgttcagggc

SEQ ID NO: 14441 - DNA, 20 bp, Artificial Sequence
  Description of Artificial Sequence: Synthetic oligonucleotide
  Target: AGXT; (-) strand; PAM type: YTN; PAM sequence: CTG
ccctatcctgtgtgctgttc

SEQ ID NO: 14442 - DNA, 20 bp, Artificial Sequence
  Description of Artificial Sequence: Synthetic oligonucleotide
  Target: AGXT; (-) strand; PAM type: YTN; PAM sequence: CTC
tgccctatcctgtgtgctgt

SEQ ID NO: 14443 - DNA, 20 bp, Artificial Sequence
  Description of Artificial Sequence: Synthetic oligonucleotide
  Target: AGXT; (-) strand; PAM type: YTN; PAM sequence: CTG
tctctgccctatcctgtgtg

SEQ ID NO: 14444 - DNA, 20 bp, Artificial Sequence
  Description of Artificial Sequence: Synthetic oligonucleotide
  Target: AGXT; (-) strand; PAM type: YTN; PAM sequence: CTC
cctgtctctgccctatcctg

SEQ ID NO: 14445 - DNA, 20 bp, Artificial Sequence
  Description of Artificial Sequence: Synthetic oligonucleotide
  Target: AGXT; (-) strand; PAM type: YTN; PAM sequence: CTC
accccctccctgtctctgcc

SEQ ID NO: 14446 - DNA, 20 bp, Artificial Sequence
  Description of Artificial Sequence: Synthetic oligonucleotide
  Target: AGXT; (-) strand; PAM type: YTN; PAM sequence: CTC
caggaatcaggccctcaccc

SEQ ID NO: 14447 - DNA, 20 bp, Artificial Sequence
  Description of Artificial Sequence: Synthetic oligonucleotide
  Target: AGXT; (-) strand; PAM type: YTN; PAM sequence: CTG
gggactccaggaatcaggcc

SEQ ID NO: 14448 - DNA, 20 bp, Artificial Sequence
  Description of Artificial Sequence: Synthetic oligonucleotide
  Target: AGXT; (-) strand; PAM type: YTN; PAM sequence: TTG
gagctggggactccaggaat

SEQ ID NO: 14449 - DNA, 20 bp, Artificial Sequence
  Description of Artificial Sequence: Synthetic oligonucleotide
  Target: AGXT; (-) strand; PAM type: YTN; PAM sequence: CTG
ttggagctggggactccagg

SEQ ID NO: 14450 - DNA, 20 bp, Artificial Sequence
  Description of Artificial Sequence: Synthetic oligonucleotide
  Target: AGXT; (-) strand; PAM type: YTN; PAM sequence: CTC
tgttggagctggggactcca

SEQ ID NO: 14451 - DNA, 20 bp, Artificial Sequence
  Description of Artificial Sequence: Synthetic oligonucleotide
  Target: AGXT; (-) strand; PAM type: YTN; PAM sequence: TTG
acctctgttggagctgggga

SEQ ID NO: 14452 - DNA, 20 bp, Artificial Sequence
  Description of Artificial Sequence: Synthetic oligonucleotide
  Target: AGXT; (-) strand; PAM type: YTN; PAM sequence: CTT
gacctctgttggagctgggg

SEQ ID NO: 14453 - DNA, 20 bp, Artificial Sequence
  Description of Artificial Sequence: Synthetic oligonucleotide
  Target: AGXT; (-) strand; PAM type: YTN; PAM sequence: CTG
aaggatgaggggtgagtgag

SEQ ID NO: 14454 - DNA, 20 bp, Artificial Sequence
  Description of Artificial Sequence: Synthetic oligonucleotide
  Target: AGXT; (-) strand; PAM type: YTN; PAM sequence: CTG
gcacaccacaggtgtgatgg

SEQ ID NO: 14455 - DNA, 20 bp, Artificial Sequence
  Description of Artificial Sequence: Synthetic oligonucleotide
  Target: AGXT; (-) strand; PAM type: YTN; PAM sequence: CTG
gtccagggctggcacaccac

SEQ ID NO: 14456 - DNA, 20 bp, Artificial Sequence
  Description of Artificial Sequence: Synthetic oligonucleotide
  Target: AGXT; (-) strand; PAM type: YTN; PAM sequence: CTG
gcacaaagagtgtacctggt

SEQ ID NO: 14457 - DNA, 20 bp, Artificial Sequence
  Description of Artificial Sequence: Synthetic oligonucleotide
  Target: AGXT; (-) strand; PAM type: YTN; PAM sequence: CTG
gcccagggctggcacaaaga

SEQ ID NO: 14458 - DNA, 20 bp, Artificial Sequence
  Description of Artificial Sequence: Synthetic oligonucleotide
  Target: AGXT; (-) strand; PAM type: YTN; PAM sequence: CTG
cacctggcccagggctggca

SEQ ID NO: 14459 - DNA, 20 bp, Artificial Sequence
  Description of Artificial Sequence: Synthetic oligonucleotide
  Target: AGXT; (-) strand; PAM type: YTN; PAM sequence: CTC
ccgggagtcagggctgcacc

SEQ ID NO: 14460 - DNA, 20 bp, Artificial Sequence
  Description of Artificial Sequence: Synthetic oligonucleotide
  Target: AGXT; (-) strand; PAM type: YTN; PAM sequence: CTC
cccaagcagagagtgagctc

SEQ ID NO: 14461 - DNA, 20 bp, Artificial Sequence
  Description of Artificial Sequence: Synthetic oligonucleotide
  Target: AGXT; (-) strand; PAM type: YTN; PAM sequence: CTG
accagtgcctccccaagcag

SEQ ID NO: 14462 - DNA, 20 bp, Artificial Sequence
  Description of Artificial Sequence: Synthetic oligonucleotide
  Target: AGXT; (-) strand; PAM type: YTN; PAM sequence: CTC
aggccacactgaccagtgcc

SEQ ID NO: 14463 - DNA, 20 bp, Artificial Sequence
  Description of Artificial Sequence: Synthetic oligonucleotide
  Target: AGXT; (-) strand; PAM type: YTN; PAM sequence: TTC
tcaggccacactgaccagtg

SEQ ID NO: 14464 - DNA, 20 bp, Artificial Sequence
  Description of Artificial Sequence: Synthetic oligonucleotide
  Target: AGXT; (-) strand; PAM type: YTN; PAM sequence: TTT
ctcaggccacactgaccagt

SEQ ID NO: 14465 - DNA, 20 bp, Artificial Sequence
  Description of Artificial Sequence: Synthetic oligonucleotide
  Target: AGXT; (-) strand; PAM type: YTN; PAM sequence: CTT
tctcaggccacactgaccag

SEQ ID NO: 14466 - DNA, 20 bp, Artificial Sequence
  Description of Artificial Sequence: Synthetic oligonucleotide
  Target: AGXT; (-) strand; PAM type: YTN; PAM sequence: CTC
aaatgccctttctcaggcca

SEQ ID NO: 14467 - DNA, 20 bp, Artificial Sequence
  Description of Artificial Sequence: Synthetic oligonucleotide
  Target: AGXT; (-) strand; PAM type: YTN; PAM sequence: CTC
agctcaaatgccctttctca

SEQ ID NO: 14468 - DNA, 20 bp, Artificial Sequence
  Description of Artificial Sequence: Synthetic oligonucleotide
  Target: AGXT; (-) strand; PAM type: YTN; PAM sequence: TTG
acagagctcagctcaaatgc

SEQ ID NO: 14469 - DNA, 20 bp, Artificial Sequence
  Description of Artificial Sequence: Synthetic oligonucleotide
  Target: AGXT; (-) strand; PAM type: YTN; PAM sequence: CTT
gacagagctcagctcaaatg

SEQ ID NO: 14470 - DNA, 20 bp, Artificial Sequence
  Description of Artificial Sequence: Synthetic oligonucleotide
  Target: AGXT; (-) strand; PAM type: YTN; PAM sequence: CTC
ttgacagagctcagctcaaa

SEQ ID NO: 14471 - DNA, 20 bp, Artificial Sequence
  Description of Artificial Sequence: Synthetic oligonucleotide
  Target: AGXT; (-) strand; PAM type: YTN; PAM sequence: CTG
gggcactcttgacagagctc

SEQ ID NO: 14472 - DNA, 20 bp, Artificial Sequence
  Description of Artificial Sequence: Synthetic oligonucleotide
  Target: AGXT; (-) strand; PAM type: YTN; PAM sequence: CTC
ctggggcactcttgacagag

SEQ ID NO: 14473 - DNA, 20 bp, Artificial Sequence
  Description of Artificial Sequence: Synthetic oligonucleotide
  Target: AGXT; (-) strand; PAM type: YTN; PAM sequence: TTG
gagccaacgctcctggggca

SEQ ID NO: 14474 - DNA, 20 bp, Artificial Sequence
  Description of Artificial Sequence: Synthetic oligonucleotide
  Target: AGXT; (-) strand; PAM type: YTN; PAM sequence: CTG
ttggagccaacgctcctggg

SEQ ID NO: 14475 - DNA, 20 bp, Artificial Sequence
  Description of Artificial Sequence: Synthetic oligonucleotide
  Target: AGXT; (-) strand; PAM type: YTN; PAM sequence: CTG
ctgttggagccaacgctcct

SEQ ID NO: 14476 - DNA, 20 bp, Artificial Sequence
  Description of Artificial Sequence: Synthetic oligonucleotide
  Target: AGXT; (-) strand; PAM type: YTN; PAM sequence: TTG
acccccctgctgttggagcc

SEQ ID NO: 14477 - DNA, 20 bp, Artificial Sequence
  Description of Artificial Sequence: Synthetic oligonucleotide
  Target: AGXT; (-) strand; PAM type: YTN; PAM sequence: CTT
gacccccctgctgttggagc

SEQ ID NO: 14478 - DNA, 20 bp, Artificial Sequence
  Description of Artificial Sequence: Synthetic oligonucleotide
  Target: AGXT; (-) strand; PAM type: YTN; PAM sequence: CTG
tgtgtagagccagggccatc

SEQ ID NO: 14479 - DNA, 20 bp, Artificial Sequence
  Description of Artificial Sequence: Synthetic oligonucleotide
  Target: AGXT; (-) strand; PAM type: YTN; PAM sequence: CTC
tgtgtgtagagccagggcca

SEQ ID NO: 14480 - DNA, 20 bp, Artificial Sequence
  Description of Artificial Sequence: Synthetic oligonucleotide
  Target: AGXT; (-) strand; PAM type: YTN; PAM sequence: CTC
tctgtgtgtagagccagggc

SEQ ID NO: 14481 - DNA, 20 bp, Artificial Sequence
  Description of Artificial Sequence: Synthetic oligonucleotide
  Target: AGXT; (-) strand; PAM type: YTN; PAM sequence: CTG
cccaatgagagcctctctgt

SEQ ID NO: 14482 - DNA, 20 bp, Artificial Sequence
  Description of Artificial Sequence: Synthetic oligonucleotide
  Target: AGXT; (-) strand; PAM type: YTN; PAM sequence: CTC
tgcccaatgagagcctctct

SEQ ID NO: 14483 - DNA, 20 bp, Artificial Sequence
  Description of Artificial Sequence: Synthetic oligonucleotide
  Target: AGXT; (-) strand; PAM type: YTN; PAM sequence: CTG
aagaggagggtggactctgc

SEQ ID NO: 14484 - DNA, 20 bp, Artificial Sequence
  Description of Artificial Sequence: Synthetic oligonucleotide
  Target: AGXT; (-) strand; PAM type: YTN; PAM sequence: CTG
cctgaagaggagggtggact

SEQ ID NO: 14485 - DNA, 20 bp, Artificial Sequence
  Description of Artificial Sequence: Synthetic oligonucleotide
  Target: AGXT; (-) strand; PAM type: YTN; PAM sequence: CTG
cctgcctgaagaggagggtg

SEQ ID NO: 14486 - DNA, 20 bp, Artificial Sequence
  Description of Artificial Sequence: Synthetic oligonucleotide
  Target: AGXT; (-) strand; PAM type: YTN; PAM sequence: CTG
gctgcctgcctgaagaggag

SEQ ID NO: 14487 - DNA, 20 bp, Artificial Sequence
  Description of Artificial Sequence: Synthetic oligonucleotide
  Target: AGXT; (-) strand; PAM type: YTN; PAM sequence: CTG
gaccccacccaccgtggcac

SEQ ID NO: 14488 - DNA, 20 bp, Artificial Sequence
  Description of Artificial Sequence: Synthetic oligonucleotide
  Target: AGXT; (-) strand; PAM type: YTN; PAM sequence: CTG
tgagggctggaccccaccca

SEQ ID NO: 14489 - DNA, 20 bp, Artificial Sequence
  Description of Artificial Sequence: Synthetic oligonucleotide
  Target: AGXT; (-) strand; PAM type: YTN; PAM sequence: CTG
agcagggccctgtgagggct

SEQ ID NO: 14490 - DNA, 20 bp, Artificial Sequence
  Description of Artificial Sequence: Synthetic oligonucleotide
  Target: AGXT; (-) strand; PAM type: YTN; PAM sequence: CTG
ctgagcagggccctgtgagg

SEQ ID NO: 14491 - DNA, 20 bp, Artificial Sequence
  Description of Artificial Sequence: Synthetic oligonucleotide
  Target: AGXT; (-) strand; PAM type: YTN; PAM sequence: TTG
ggcacccgtggccctgctga

SEQ ID NO: 14492 - DNA, 20 bp, Artificial Sequence
  Description of Artificial Sequence: Synthetic oligonucleotide
  Target: AGXT; (-) strand; PAM type: YTN; PAM sequence: CTG
tagaagccagtgttgggcac

SEQ ID NO: 14493 - DNA, 20 bp, Artificial Sequence
  Description of Artificial Sequence: Synthetic oligonucleotide
  Target: AGXT; (-) strand; PAM type: YTN; PAM sequence: CTG
ggtgcaggacagagtgggcc

SEQ ID NO: 14494 - DNA, 20 bp, Artificial Sequence
  Description of Artificial Sequence: Synthetic oligonucleotide
  Target: AGXT; (-) strand; PAM type: YTN; PAM sequence: CTC
ctgggtgcaggacagagtgg

SEQ ID NO: 14495 - DNA, 20 bp, Artificial Sequence
  Description of Artificial Sequence: Synthetic oligonucleotide
  Target: AGXT; (-) strand; PAM type: YTN; PAM sequence: CTC
gggctcctgggtgcaggaca

SEQ ID NO: 14496 - DNA, 20 bp, Artificial Sequence
  Description of Artificial Sequence: Synthetic oligonucleotide
  Target: AGXT; (-) strand; PAM type: YTN; PAM sequence: TTG
gtcatcgggtgcactcgggc

SEQ ID NO: 14497 - DNA, 20 bp, Artificial Sequence
  Description of Artificial Sequence: Synthetic oligonucleotide
  Target: AGXT; (-) strand; PAM type: YTN; PAM sequence: CTT
ggtcatcgggtgcactcggg

SEQ ID NO: 14498 - DNA, 20 bp, Artificial Sequence
  Description of Artificial Sequence: Synthetic oligonucleotide
  Target: AGXT; (-) strand; PAM type: YTN; PAM sequence: CTC
cagggtccttggtcatcggg

SEQ ID NO: 14499 - DNA, 20 bp, Artificial Sequence
  Description of Artificial Sequence: Synthetic oligonucleotide
  Target: AGXT; (-) strand; PAM type: YTN; PAM sequence: CTG
cagtgtgtagtggcctccag

SEQ ID NO: 14500 - DNA, 20 bp, Artificial Sequence
  Description of Artificial Sequence: Synthetic oligonucleotide
  Target: AGXT; (-) strand; PAM type: YTN; PAM sequence: CTC
ctgcagtgtgtagtggcctc

SEQ ID NO: 14501 - DNA, 20 bp, Artificial Sequence
  Description of Artificial Sequence: Synthetic oligonucleotide
  Target: AGXT; (-) strand; PAM type: YTN; PAM sequence: CTC
cacctcctgcagtgtgtagt

SEQ ID NO: 14502 - DNA, 20 bp, Artificial Sequence
  Description of Artificial Sequence: Synthetic oligonucleotide
  Target: AGXT; (-) strand; PAM type: YTN; PAM sequence: CTC
ctccacctcctgcagtgtgt

SEQ ID NO: 14503 - DNA, 20 bp, Artificial Sequence
  Description of Artificial Sequence: Synthetic oligonucleotide
  Target: AGXT; (-) strand; PAM type: YTN; PAM sequence: CTA
cctcctccacctcctgcagt

SEQ ID NO: 14504 - DNA, 20 bp, Artificial Sequence
  Description of Artificial Sequence: Synthetic oligonucleotide
  Target: AGXT; (-) strand; PAM type: YTN; PAM sequence: CTG
acccccaccccgggtcccct

SEQ ID NO: 14505 - DNA, 20 bp, Artificial Sequence
  Description of Artificial Sequence: Synthetic oligonucleotide
  Target: AGXT; (-) strand; PAM type: YTN; PAM sequence: CTC
ccggccctgacccccacccc

SEQ ID NO: 14506 - DNA, 20 bp, Artificial Sequence
  Description of Artificial Sequence: Synthetic oligonucleotide
  Target: AGXT; (-) strand; PAM type: YTN; PAM sequence: CTC
ctcccggccctgacccccac

SEQ ID NO: 14507 - DNA, 20 bp, Artificial Sequence
  Description of Artificial Sequence: Synthetic oligonucleotide
  Target: AGXT; (-) strand; PAM type: YTN; PAM sequence: CTC
ccacctcctcccggccctga

SEQ ID NO: 14508 - DNA, 20 bp, Artificial Sequence
  Description of Artificial Sequence: Synthetic oligonucleotide
  Target: AGXT; (-) strand; PAM type: YTN; PAM sequence: CTG
agccagcatgcccactccca

SEQ ID NO: 14509 - DNA, 20 bp, Artificial Sequence
  Description of Artificial Sequence: Synthetic oligonucleotide
  Target: AGXT; (-) strand; PAM type: YTN; PAM sequence: TTC
caggcagcccctgagccagc

SEQ ID NO: 14510 - DNA, 20 bp, Artificial Sequence
  Description of Artificial Sequence: Synthetic oligonucleotide
  Target: AGXT; (-) strand; PAM type: YTN; PAM sequence: CTG
gccaattccaggcagcccct

SEQ ID NO: 14511 - DNA, 20 bp, Artificial Sequence
  Description of Artificial Sequence: Synthetic oligonucleotide
  Target: AGXT; (-) strand; PAM type: YTN; PAM sequence: CTG
gctggccaattccaggcagc

SEQ ID NO: 14512 - DNA, 20 bp, Artificial Sequence
  Description of Artificial Sequence: Synthetic oligonucleotide
  Target: AGXT; (-) strand; PAM type: YTN; PAM sequence: CTG
ctggctggccaattccaggc

SEQ ID NO: 14513 - DNA, 20 bp, Artificial Sequence
  Description of Artificial Sequence: Synthetic oligonucleotide
  Target: AGXT; (-) strand; PAM type: YTN; PAM sequence: CTC
ccggccatgatcccaccctg

SEQ ID NO: 14514 - DNA, 20 bp, Artificial Sequence
  Description of Artificial Sequence: Synthetic oligonucleotide
  Target: AGXT; (-) strand; PAM type: YTN; PAM sequence: CTG
agggtcagccaccagcctcc

SEQ ID NO: 14515 - DNA, 20 bp, Artificial Sequence
  Description of Artificial Sequence: Synthetic oligonucleotide
  Target: AGXT; (-) strand; PAM type: YTN; PAM sequence: CTA
ggatgggctgagggtcagcc

SEQ ID NO: 14516 - DNA, 20 bp, Artificial Sequence
  Description of Artificial Sequence: Synthetic oligonucleotide
  Target: AGXT; (-) strand; PAM type: YTN; PAM sequence: CTC
accagatgctaggatgggct

SEQ ID NO: 14517 - DNA, 20 bp, Artificial Sequence
  Description of Artificial Sequence: Synthetic oligonucleotide
  Target: AGXT; (-) strand; PAM type: YTN; PAM sequence: CTG
tggccgctcaccagatgcta

SEQ ID NO: 14518 - DNA, 20 bp, Artificial Sequence
  Description of Artificial Sequence: Synthetic oligonucleotide
  Target: AGXT; (-) strand; PAM type: YTN; PAM sequence: CTC
ccctgtggccgctcaccaga

SEQ ID NO: 14519 - DNA, 20 bp, Artificial Sequence
  Description of Artificial Sequence: Synthetic oligonucleotide
  Target: AGXT; (-) strand; PAM type: YTN; PAM sequence: TTC
ccaggtaatggaaccctccc

SEQ ID NO: 14520 - DNA, 20 bp, Artificial Sequence
  Description of Artificial Sequence: Synthetic oligonucleotide
  Target: AGXT; (-) strand; PAM type: YTN; PAM sequence: TTC
ccaccattcccaggtaatgg

SEQ ID NO: 14521 - DNA, 20 bp, Artificial Sequence
  Description of Artificial Sequence: Synthetic oligonucleotide
  Target: AGXT; (-) strand; PAM type: YTN; PAM sequence: CTT
cccaccattcccaggtaatg

SEQ ID NO: 14522 - DNA, 20 bp, Artificial Sequence
  Description of Artificial Sequence: Synthetic oligonucleotide
  Target: AGXT; (-) strand; PAM type: YTN; PAM sequence: TTA
ccagtcttcccaccattccc

SEQ ID NO: 14523 - DNA, 20 bp, Artificial Sequence
  Description of Artificial Sequence: Synthetic oligonucleotide
  Target: AGXT; (-) strand; PAM type: YTN; PAM sequence: CTT
accagtcttcccaccattcc

SEQ ID NO: 14524 - DNA, 20 bp, Artificial Sequence
  Description of Artificial Sequence: Synthetic oligonucleotide
  Target: AGXT; (-) strand; PAM type: YTN; PAM sequence: CTC
cttaccagtcttcccaccat

SEQ ID NO: 14525 - DNA, 20 bp, Artificial Sequence
  Description of Artificial Sequence: Synthetic oligonucleotide
  Target: AGXT; (-) strand; PAM type: YTN; PAM sequence: CTG
ccagacagaagcctccttac

SEQ ID NO: 14526 - DNA, 20 bp, Artificial Sequence
  Description of Artificial Sequence: Synthetic oligonucleotide
  Target: AGXT; (-) strand; PAM type: YTN; PAM sequence: TTC
cctgccagacagaagcctcc

SEQ ID NO: 14527 - DNA, 20 bp, Artificial Sequence
  Description of Artificial Sequence: Synthetic oligonucleotide
  Target: AGXT; (-) strand; PAM type: YTN; PAM sequence: TTT
ccctgccagacagaagcctc

SEQ ID NO: 14528 - DNA, 20 bp, Artificial Sequence
  Description of Artificial Sequence: Synthetic oligonucleotide
  Target: AGXT; (-) strand; PAM type: YTN; PAM sequence: CTC
agtttccctgccagacagaa

SEQ ID NO: 14529 - DNA, 20 bp, Artificial Sequence
  Description of Artificial Sequence: Synthetic oligonucleotide
  Target: AGXT; (-) strand; PAM type: YTN; PAM sequence: CTG
actcagtttccctgccagac

SEQ ID NO: 14530 - DNA, 20 bp, Artificial Sequence
  Description of Artificial Sequence: Synthetic oligonucleotide
  Target: AGXT; (-) strand; PAM type: YTN; PAM sequence: CTC
ctgactcagtttccctgcca

SEQ ID NO: 14531 - DNA, 20 bp, Artificial Sequence
  Description of Artificial Sequence: Synthetic oligonucleotide
  Target: AGXT; (-) strand; PAM type: YTN; PAM sequence: CTA
caggaccaggctcctgactc

SEQ ID NO: 14532 - DNA, 20 bp, Artificial Sequence
  Description of Artificial Sequence: Synthetic oligonucleotide
  Target: AGXT; (-) strand; PAM type: YTN; PAM sequence: CTG
cctacaggaccaggctcctg

SEQ ID NO: 14533 - DNA, 20 bp, Artificial Sequence
  Description of Artificial Sequence: Synthetic oligonucleotide
  Target: AGXT; (-) strand; PAM type: YTN; PAM sequence: CTG
gccctgcctacaggaccagg

SEQ ID NO: 14534 - DNA, 20 bp, Artificial Sequence
  Description of Artificial Sequence: Synthetic oligonucleotide
  Target: AGXT; (-) strand; PAM type: YTN; PAM sequence: CTC
tggccctgcctacaggacca

SEQ ID NO: 14535 - DNA, 20 bp, Artificial Sequence
  Description of Artificial Sequence: Synthetic oligonucleotide
  Target: AGXT; (-) strand; PAM type: YTN; PAM sequence: CTC
tctggccctgcctacaggac

SEQ ID NO: 14536 - DNA, 20 bp, Artificial Sequence
  Description of Artificial Sequence: Synthetic oligonucleotide
  Target: AGXT; (-) strand; PAM type: YTN; PAM sequence: CTC
cagcctctctggccctgcct

SEQ ID NO: 14537 - DNA, 20 bp, Artificial Sequence
  Description of Artificial Sequence: Synthetic oligonucleotide
  Target: AGXT; (-) strand; PAM type: YTN; PAM sequence: CTG
cctccagcctctctggccct

SEQ ID NO: 14538 - DNA, 20 bp, Artificial Sequence
  Description of Artificial Sequence: Synthetic oligonucleotide
  Target: AGXT; (-) strand; PAM type: YTN; PAM sequence: CTC
ctgcctccagcctctctggc

SEQ ID NO: 14539 - DNA, 20 bp, Artificial Sequence
  Description of Artificial Sequence: Synthetic oligonucleotide
  Target: AGXT; (-) strand; PAM type: YTN; PAM sequence: CTC
ggcctcctgcctccagcctc

SEQ ID NO: 14540 - DNA, 20 bp, Artificial Sequence
  Description of Artificial Sequence: Synthetic oligonucleotide
  Target: AGXT; (-) strand; PAM type: YTN; PAM sequence: CTC
caactcggcctcctgcctcc

SEQ ID NO: 14541 - DNA, 20 bp, Artificial Sequence
  Description of Artificial Sequence: Synthetic oligonucleotide
  Target: AGXT; (-) strand; PAM type: YTN; PAM sequence: CTA
gactccaactcggcctcctg

SEQ ID NO: 14542 - DNA, 20 bp, Artificial Sequence
  Description of Artificial Sequence: Synthetic oligonucleotide
  Target: AGXT; (-) strand; PAM type: YTN; PAM sequence: CTG
cagcctagactccaactcgg

SEQ ID NO: 14543 - DNA, 20 bp, Artificial Sequence
  Description of Artificial Sequence: Synthetic oligonucleotide
  Target: AGXT; (-) strand; PAM type: YTN; PAM sequence: TTC
tgcagcctagactccaactc

SEQ ID NO: 14544 - DNA, 20 bp, Artificial Sequence
  Description of Artificial Sequence: Synthetic oligonucleotide
  Target: AGXT; (-) strand; PAM type: YTN; PAM sequence: CTG
agtgtcagggacatgttctg

SEQ ID NO: 14545 - DNA, 20 bp, Artificial Sequence
  Description of Artificial Sequence: Synthetic oligonucleotide
  Target: AGXT; (-) strand; PAM type: YTN; PAM sequence: TTC
agcccacagggtggggtatc

SEQ ID NO: 14546 - DNA, 20 bp, Artificial Sequence
  Description of Artificial Sequence: Synthetic oligonucleotide
  Target: AGXT; (-) strand; PAM type: YTN; PAM sequence: CTT
cagcccacagggtggggtat

SEQ ID NO: 14547 - DNA, 20 bp, Artificial Sequence
  Description of Artificial Sequence: Synthetic oligonucleotide
  Target: AGXT; (-) strand; PAM type: YTN; PAM sequence: TTG
acttcagcccacagggtggg

SEQ ID NO: 14548 - DNA, 20 bp, Artificial Sequence
  Description of Artificial Sequence: Synthetic oligonucleotide
  Target: AGXT; (-) strand; PAM type: YTN; PAM sequence: CTG
aggttgacttcagcccacag

SEQ ID NO: 14549 - DNA, 20 bp, Artificial Sequence
  Description of Artificial Sequence: Synthetic oligonucleotide
  Target: AGXT; (-) strand; PAM type: YTN; PAM sequence: CTC
cgggtaggctgaggttgact

SEQ ID NO: 14550 - DNA, 20 bp, Artificial Sequence
  Description of Artificial Sequence: Synthetic oligonucleotide
  Target: AGXT; (-) strand; PAM type: YTN; PAM sequence: CTG
agtccccacactccgggtag

SEQ ID NO: 14551 - DNA, 20 bp, Artificial Sequence
  Description of Artificial Sequence: Synthetic oligonucleotide
  Target: AGXT; (-) strand; PAM type: YTN; PAM sequence: CTA
gatggactgagtccccacac

SEQ ID NO: 14552 - DNA, 20 bp, Artificial Sequence
  Description of Artificial Sequence: Synthetic oligonucleotide
  Target: AGXT; (-) strand; PAM type: YTN; PAM sequence: TTG
ctagatggactgagtcccca

SEQ ID NO: 14553 - DNA, 20 bp, Artificial Sequence
  Description of Artificial Sequence: Synthetic oligonucleotide
  Target: AGXT; (-) strand; PAM type: YTN; PAM sequence: CTG
ttgctagatggactgagtcc

SEQ ID NO: 14554 - DNA, 20 bp, Artificial Sequence
  Description of Artificial Sequence: Synthetic oligonucleotide
  Target: AGXT; (-) strand; PAM type: YTN; PAM sequence: CTG
tgagggctgttgctagatgg

SEQ ID NO: 14555 - DNA, 20 bp, Artificial Sequence
  Description of Artificial Sequence: Synthetic oligonucleotide
  Target: AGXT; (-) strand; PAM type: YTN; PAM sequence: CTG
gcctgtgagggctgttgcta

SEQ ID NO: 14556 - DNA, 20 bp, Artificial Sequence
  Description of Artificial Sequence: Synthetic oligonucleotide
  Target: AGXT; (-) strand; PAM type: YTN; PAM sequence: TTG
cctggcctgtgagggctgtt

SEQ ID NO: 14557 - DNA, 20 bp, Artificial Sequence
  Description of Artificial Sequence: Synthetic oligonucleotide
  Target: AGXT; (-) strand; PAM type: YTN; PAM sequence: CTG
ttgcctggcctgtgagggct

SEQ ID NO: 14558 - DNA, 20 bp, Artificial Sequence
  Description of Artificial Sequence: Synthetic oligonucleotide
  Target: AGXT; (-) strand; PAM type: YTN; PAM sequence: TTG
gtgcagagatggaggagggt

SEQ ID NO: 14559 - DNA, 20 bp, Artificial Sequence
  Description of Artificial Sequence: Synthetic oligonucleotide
  Target: AGXT; (-) strand; PAM type: YTN; PAM sequence: TTT
ggtgcagagatggaggaggg

SEQ ID NO: 14560 - DNA, 20 bp, Artificial Sequence
  Description of Artificial Sequence: Synthetic oligonucleotide
  Target: AGXT; (-) strand; PAM type: YTN; PAM sequence: CTT
tggtgcagagatggaggagg

SEQ ID NO: 14561 - DNA, 20 bp, Artificial Sequence
  Description of Artificial Sequence: Synthetic oligonucleotide
  Target: AGXT; (-) strand; PAM type: YTN; PAM sequence: TTC
caagaacaggactttggtgc

SEQ ID NO: 14562 - DNA, 20 bp, Artificial Sequence
  Description of Artificial Sequence: Synthetic oligonucleotide
  Target: AGXT; (-) strand; PAM type: YTN; PAM sequence: TTT
ccaagaacaggactttggtg

SEQ ID NO: 14563 - DNA, 20 bp, Artificial Sequence
  Description of Artificial Sequence: Synthetic oligonucleotide
  Target: AGXT; (-) strand; PAM type: YTN; PAM sequence: TTT
tccaagaacaggactttggt

SEQ ID NO: 14564 - DNA, 20 bp, Artificial Sequence
  Description of Artificial Sequence: Synthetic oligonucleotide
  Target: AGXT; (-) strand; PAM type: YTN; PAM sequence: CTT
ttccaagaacaggactttgg

SEQ ID NO: 14565 - DNA, 20 bp, Artificial Sequence
  Description of Artificial Sequence: Synthetic oligonucleotide
  Target: AGXT; (-) strand; PAM type: YTN; PAM sequence: CTC
cgggacaagggcttttccaa

SEQ ID NO: 14566 - DNA, 20 bp, Artificial Sequence
  Description of Artificial Sequence: Synthetic oligonucleotide
  Target: AGXT; (-) strand; PAM type: YTN; PAM sequence: CTC
cgctccgggacaagggcttt

SEQ ID NO: 14567 - DNA, 20 bp, Artificial Sequence
  Description of Artificial Sequence: Synthetic oligonucleotide
  Target: AGXT; (-) strand; PAM type: YTN; PAM sequence: CTG
gggcatctccgctccgggac

SEQ ID NO: 14568 - DNA, 20 bp, Artificial Sequence
  Description of Artificial Sequence: Synthetic oligonucleotide
  Target: AGXT; (-) strand; PAM type: YTN; PAM sequence: CTG
atggtgtgcatgggaggagg

SEQ ID NO: 14569 - DNA, 20 bp, Artificial Sequence
  Description of Artificial Sequence: Synthetic oligonucleotide
  Target: AGXT; (-) strand; PAM type: YTN; PAM sequence: CTC
cctgatggtgtgcatgggag

SEQ ID NO: 14570 - DNA, 20 bp, Artificial Sequence
  Description of Artificial Sequence: Synthetic oligonucleotide
  Target: AGXT; (-) strand; PAM type: YTN; PAM sequence: CTC
ctccctgatggtgtgcatgg

SEQ ID NO: 14571 - DNA, 20 bp, Artificial Sequence
  Description of Artificial Sequence: Synthetic oligonucleotide
  Target: AGXT; (-) strand; PAM type: YTN; PAM sequence: CTA
ctcctccctgatggtgtgca

SEQ ID NO: 14572 - DNA, 20 bp, Artificial Sequence
  Description of Artificial Sequence: Synthetic oligonucleotide
  Target: AGXT; (-) strand; PAM type: YTN; PAM sequence: CTC
tactcctccctgatggtgtg

SEQ ID NO: 14573 - DNA, 20 bp, Artificial Sequence
  Description of Artificial Sequence: Synthetic oligonucleotide
  Target: AGXT; (-) strand; PAM type: YTN; PAM sequence: CTG
cctctactcctccctgatgg

SEQ ID NO: 14574 - DNA, 20 bp, Artificial Sequence
  Description of Artificial Sequence: Synthetic oligonucleotide
  Target: AGXT; (-) strand; PAM type: YTN; PAM sequence: CTG
ggcctgcctctactcctccc

SEQ ID NO: 14575 - DNA, 20 bp, Artificial Sequence
  Description of Artificial Sequence: Synthetic oligonucleotide
  Target: AGXT; (-) strand; PAM type: YTN; PAM sequence: CTC
caggtagcaggggctgggcc

SEQ ID NO: 14576 - DNA, 20 bp, Artificial Sequence
  Description of Artificial Sequence: Synthetic oligonucleotide
  Target: AGXT; (-) strand; PAM type: YTN; PAM sequence: CTC
agaggggcaggggccagaac

SEQ ID NO: 14577 - DNA, 20 bp, Artificial Sequence
  Description of Artificial Sequence: Synthetic oligonucleotide
  Target: AGXT; (-) strand; PAM type: YTN; PAM sequence: CTG
tgggtggagctcagaggggc

SEQ ID NO: 14578 - DNA, 20 bp, Artificial Sequence
  Description of Artificial Sequence: Synthetic oligonucleotide
  Target: AGXT; (-) strand; PAM type: YTN; PAM sequence: CTG
aggaagcagggacggctgtg

SEQ ID NO: 14579 - DNA, 20 bp, Artificial Sequence
  Description of Artificial Sequence: Synthetic oligonucleotide
  Target: AGXT; (-) strand; PAM type: YTN; PAM sequence: CTG
ggccaggccctgaggaagca

SEQ ID NO: 14580 - DNA, 20 bp, Artificial Sequence
  Description of Artificial Sequence: Synthetic oligonucleotide
  Target: AGXT; (-) strand; PAM type: YTN; PAM sequence: TTG
tgctgggccaggccctgagg

SEQ ID NO: 14581 - DNA, 20 bp, Artificial Sequence
  Description of Artificial Sequence: Synthetic oligonucleotide
  Target: AGXT; (-) strand; PAM type: YTN; PAM sequence: CTT
gtgctgggccaggccctgag

SEQ ID NO: 14582 - DNA, 20 bp, Artificial Sequence
  Description of Artificial Sequence: Synthetic oligonucleotide
  Target: AGXT; (-) strand; PAM type: YTN; PAM sequence: CTG
gcttgtgctgggccaggccc

SEQ ID NO: 14583 - DNA, 20 bp, Artificial Sequence
  Description of Artificial Sequence: Synthetic oligonucleotide
  Target: AGXT; (-) strand; PAM type: YTN; PAM sequence: TTA
agaacagcagcactggcttg

SEQ ID NO: 14584 - DNA, 20 bp, Artificial Sequence
  Description of Artificial Sequence: Synthetic oligonucleotide
  Target: AGXT; (-) strand; PAM type: YTN; PAM sequence: CTC
cccgtgggttaagaacagca

SEQ ID NO: 14585 - DNA, 20 bp, Artificial Sequence
  Description of Artificial Sequence: Synthetic oligonucleotide
  Target: AGXT; (-) strand; PAM type: YTN; PAM sequence: CTG
cagcacgccggtggacgact

SEQ ID NO: 14586 - DNA, 20 bp, Artificial Sequence
  Description of Artificial Sequence: Synthetic oligonucleotide
  Target: AGXT; (-) strand; PAM type: YTN; PAM sequence: TTC
cccgaagccatcaaggggct

SEQ ID NO: 14587 - DNA, 20 bp, Artificial Sequence
  Description of Artificial Sequence: Synthetic oligonucleotide
  Target: AGXT; (-) strand; PAM type: YTN; PAM sequence: CTG
tggcagagttccccgaagcc

SEQ ID NO: 14588 - DNA, 20 bp, Artificial Sequence
  Description of Artificial Sequence: Synthetic oligonucleotide
  Target: AGXT; (-) strand; PAM type: YTN; PAM sequence: CTC
acctgtggcagagttccccg

SEQ ID NO: 14589 - DNA, 20 bp, Artificial Sequence
  Description of Artificial Sequence: Synthetic oligonucleotide
  Target: AGXT; (-) strand; PAM type: YTN; PAM sequence: CTG
gggccaggctcacctgtggc

SEQ ID NO: 14590 - DNA, 20 bp, Artificial Sequence
  Description of Artificial Sequence: Synthetic oligonucleotide
  Target: AGXT; (-) strand; PAM type: YTN; PAM sequence: CTC
cagtccaccgccctggggcc

SEQ ID NO: 14591 - DNA, 20 bp, Artificial Sequence
  Description of Artificial Sequence: Synthetic oligonucleotide
  Target: AGXT; (-) strand; PAM type: YTN; PAM sequence: CTG
tgctccagtccaccgccctg

SEQ ID NO: 14592 - DNA, 20 bp, Artificial Sequence
  Description of Artificial Sequence: Synthetic oligonucleotide
  Target: AGXT; (-) strand; PAM type: YTN; PAM sequence: CTG
agctgtgctccagtccaccg

SEQ ID NO: 14593 - DNA, 20 bp, Artificial Sequence
  Description of Artificial Sequence: Synthetic oligonucleotide
  Target: AGXT; (-) strand; PAM type: YTN; PAM sequence: CTC
tgagctgtgctccagtccac

SEQ ID NO: 14594 - DNA, 20 bp, Artificial Sequence
  Description of Artificial Sequence: Synthetic oligonucleotide
  Target: AGXT; (-) strand; PAM type: YTN; PAM sequence: CTG
gctctgagctgtgctccagt

SEQ ID NO: 14595 - DNA, 20 bp, Artificial Sequence
  Description of Artificial Sequence: Synthetic oligonucleotide
  Target: AGXT; (-) strand; PAM type: YTN; PAM sequence: CTC
cccatagcctggctctgagc

SEQ ID NO: 14596 - DNA, 20 bp, Artificial Sequence
  Description of Artificial Sequence: Synthetic oligonucleotide
  Target: AGXT; (-) strand; PAM type: YTN; PAM sequence: CTG
gggtggggaccaggggcaga

SEQ ID NO: 14597 - DNA, 20 bp, Artificial Sequence
  Description of Artificial Sequence: Synthetic oligonucleotide
  Target: AGXT; (-) strand; PAM type: YTN; PAM sequence: CTG
caccccataccatgtgacag

SEQ ID NO: 14598 - DNA, 20 bp, Artificial Sequence
  Description of Artificial Sequence: Synthetic oligonucleotide
  Target: AGXT; (-) strand; PAM type: YTN; PAM sequence: CTG
ggaggtgcctgcaccccata

SEQ ID NO: 14599 - DNA, 20 bp, Artificial Sequence
  Description of Artificial Sequence: Synthetic oligonucleotide
  Target: AGXT; (-) strand; PAM type: YTN; PAM sequence: CTC
agcccagagcaaagaggacc

SEQ ID NO: 14600 - DNA, 20 bp, Artificial Sequence
  Description of Artificial Sequence: Synthetic oligonucleotide
  Target: AGXT; (-) strand; PAM type: YTN; PAM sequence: TTA
gactcagcccagagcaaaga

SEQ ID NO: 14601 - DNA, 20 bp, Artificial Sequence
  Description of Artificial Sequence: Synthetic oligonucleotide
  Target: AGXT; (-) strand; PAM type: YTN; PAM sequence: TTT
agactcagcccagagcaaag

SEQ ID NO: 14602 - DNA, 20 bp, Artificial Sequence
  Description of Artificial Sequence: Synthetic oligonucleotide
  Target: AGXT; (-) strand; PAM type: YTN; PAM sequence: CTT
tagactcagcccagagcaaa

SEQ ID NO: 14603 - DNA, 20 bp, Artificial Sequence
  Description of Artificial Sequence: Synthetic oligonucleotide
  Target: AGXT; (-) strand; PAM type: YTN; PAM sequence: TTG
tctttagactcagcccagag

SEQ ID NO: 14604 - DNA, 20 bp, Artificial Sequence
  Description of Artificial Sequence: Synthetic oligonucleotide
  Target: AGXT; (-) strand; PAM type: YTN; PAM sequence: CTG
gggttgtctttagactcagc

SEQ ID NO: 14605 - DNA, 20 bp, Artificial Sequence
  Description of Artificial Sequence: Synthetic oligonucleotide
  Target: AGXT; (-) strand; PAM type: YTN; PAM sequence: CTG
ggacctggggttgtctttag

SEQ ID NO: 14606 - DNA, 20 bp, Artificial Sequence
  Description of Artificial Sequence: Synthetic oligonucleotide
  Target: AGXT; (-) strand; PAM type: YTN; PAM sequence: CTG
ccctgggacctggggttgtc

SEQ ID NO: 14607 - DNA, 20 bp, Artificial Sequence
  Description of Artificial Sequence: Synthetic oligonucleotide
  Target: AGXT; (-) strand; PAM type: YTN; PAM sequence: CTG
agcctgccctgggacctggg

SEQ ID NO: 14608 - DNA, 20 bp, Artificial Sequence
  Description of Artificial Sequence: Synthetic oligonucleotide
  Target: AGXT; (-) strand; PAM type: YTN; PAM sequence: CTC
ggccagggagcacctgagcc

SEQ ID NO: 14609 - DNA, 20 bp, Artificial Sequence
  Description of Artificial Sequence: Synthetic oligonucleotide
  Target: AGXT; (-) strand; PAM type: YTN; PAM sequence: CTA
tgggggcgctcggccaggga

SEQ ID NO: 14610 - DNA, 20 bp, Artificial Sequence
  Description of Artificial Sequence: Synthetic oligonucleotide
  Target: AGXT; (-) strand; PAM type: YTN; PAM sequence: CTG
gggacagaggtcagtgggca

SEQ ID NO: 14611 - DNA, 20 bp, Artificial Sequence
  Description of Artificial Sequence: Synthetic oligonucleotide
  Target: AGXT; (-) strand; PAM type: YTN; PAM sequence: TTC
agccctggggacagaggtca

SEQ ID NO: 14612 - DNA, 20 bp, Artificial Sequence
  Description of Artificial Sequence: Synthetic oligonucleotide
  Target: AGXT; (-) strand; PAM type: YTN; PAM sequence: CTT
cagccctggggacagaggtc

SEQ ID NO: 14613 - DNA, 20 bp, Artificial Sequence
  Description of Artificial Sequence: Synthetic oligonucleotide
  Target: AGXT; (-) strand; PAM type: YTN; PAM sequence: CTC
ttcagccctggggacagagg

SEQ ID NO: 14614 - DNA, 20 bp, Artificial Sequence
  Description of Artificial Sequence: Synthetic oligonucleotide
  Target: AGXT; (-) strand; PAM type: YTN; PAM sequence: CTG
caccaagccctcttcagccc

SEQ ID NO: 14615 - DNA, 20 bp, Artificial Sequence
  Description of Artificial Sequence: Synthetic oligonucleotide
  Target: AGXT; (-) strand; PAM type: YTN; PAM sequence: CTG
gcaagatatggaagtctgca

SEQ ID NO: 14616 - DNA, 20 bp, Artificial Sequence
  Description of Artificial Sequence: Synthetic oligonucleotide
  Target: AGXT; (-) strand; PAM type: YTN; PAM sequence: CTC
ggggtgaggtggggacaggc

SEQ ID NO: 14617 - DNA, 20 bp, Artificial Sequence
  Description of Artificial Sequence: Synthetic oligonucleotide
  Target: AGXT; (-) strand; PAM type: YTN; PAM sequence: CTG
gcaatctcggggtgaggtgg

SEQ ID NO: 14618 - DNA, 20 bp, Artificial Sequence
  Description of Artificial Sequence: Synthetic oligonucleotide
  Target: AGXT; (-) strand; PAM type: YTN; PAM sequence: TTA
gtgtcctggcaatctcgggg

SEQ ID NO: 14619 - DNA, 20 bp, Artificial Sequence
  Description of Artificial Sequence: Synthetic oligonucleotide
  Target: AGXT; (-) strand; PAM type: YTN; PAM sequence: TTT
agtgtcctggcaatctcggg

SEQ ID NO: 14620 - DNA, 20 bp, Artificial Sequence
  Description of Artificial Sequence: Synthetic oligonucleotide
  Target: AGXT; (-) strand; PAM type: YTN; PAM sequence: CTT
tagtgtcctggcaatctcgg

SEQ ID NO: 14621 - DNA, 20 bp, Artificial Sequence
  Description of Artificial Sequence: Synthetic oligonucleotide
  Target: AGXT; (-) strand; PAM type: YTN; PAM sequence: CTG
gaggagggaagtggagggca

SEQ ID NO: 14622 - DNA, 20 bp, Artificial Sequence
  Description of Artificial Sequence: Synthetic oligonucleotide
  Target: AGXT; (-) strand; PAM type: YTN; PAM sequence: CTG
tgcacccccatgcggggatg

SEQ ID NO: 14623 - DNA, 20 bp, Artificial Sequence
  Description of Artificial Sequence: Synthetic oligonucleotide
  Target: AGXT; (-) strand; PAM type: YTN; PAM sequence: TTG
ccctgtgcacccccatgcgg

SEQ ID NO: 14624 - DNA, 20 bp, Artificial Sequence
  Description of Artificial Sequence: Synthetic oligonucleotide
  Target: AGXT; (-) strand; PAM type: YTN; PAM sequence: CTT
gccctgtgcacccccatgcg

SEQ ID NO: 14625 - DNA, 20 bp, Artificial Sequence
  Description of Artificial Sequence: Synthetic oligonucleotide
  Target: AGXT; (-) strand; PAM type: YTN; PAM sequence: TTC
aaggccttgccctgtgcacc

SEQ ID NO: 14626 - DNA, 20 bp, Artificial Sequence
  Description of Artificial Sequence: Synthetic oligonucleotide
  Target: AGXT; (-) strand; PAM type: YTN; PAM sequence: CTC
cattcaaggccttgccctgt

SEQ ID NO: 14627 - DNA, 20 bp, Artificial Sequence
  Description of Artificial Sequence: Synthetic oligonucleotide
  Target: AGXT; (-) strand; PAM type: YTN; PAM sequence: CTG
actccattcaaggccttgcc

SEQ ID NO: 14628 - DNA, 20 bp, Artificial Sequence
  Description of Artificial Sequence: Synthetic oligonucleotide
  Target: AGXT; (-) strand; PAM type: YTN; PAM sequence: CTC
aggaatcccatctgactcca

SEQ ID NO: 14629 - DNA, 20 bp, Artificial Sequence
  Description of Artificial Sequence: Synthetic oligonucleotide
  Target: AGXT; (-) strand; PAM type: YTN; PAM sequence: TTC
tcaggaatcccatctgactc

SEQ ID NO: 14630 - DNA, 20 bp, Artificial Sequence
  Description of Artificial Sequence: Synthetic oligonucleotide
  Target: AGXT; (-) strand; PAM type: YTN; PAM sequence: TTT
ctcaggaatcccatctgact

SEQ ID NO: 14631 - DNA, 20 bp, Artificial Sequence
  Description of Artificial Sequence: Synthetic oligonucleotide
  Target: AGXT; (-) strand; PAM type: YTN; PAM sequence: CTG
tccgcatttctcaggaatcc

SEQ ID NO: 14632 - DNA, 20 bp, Artificial Sequence
  Description of Artificial Sequence: Synthetic oligonucleotide
  Target: AGXT; (-) strand; PAM type: YTN; PAM sequence: CTC
tgtccgcatttctcaggaat

SEQ ID NO: 14633 - DNA, 20 bp, Artificial Sequence
  Description of Artificial Sequence: Synthetic oligonucleotide
  Target: AGXT; (-) strand; PAM type: YTN; PAM sequence: CTG
ggtcccaaggggctctgtcc

SEQ ID NO: 14634 - DNA, 20 bp, Artificial Sequence
  Description of Artificial Sequence: Synthetic oligonucleotide
  Target: AGXT; (-) strand; PAM type: YTN; PAM sequence: CTG
ctgggtcccaaggggctctg

SEQ ID NO: 14635 - DNA, 20 bp, Artificial Sequence
  Description of Artificial Sequence: Synthetic oligonucleotide
  Target: AGXT; (-) strand; PAM type: YTN; PAM sequence: CTG
cagacgggactgctgggtcc

SEQ ID NO: 14636 - DNA, 20 bp, Artificial Sequence
  Description of Artificial Sequence: Synthetic oligonucleotide
  Target: AGXT; (-) strand; PAM type: YTN; PAM sequence: CTC
agacctgcagacgggactgc

SEQ ID NO: 14637 - DNA, 20 bp, Artificial Sequence
  Description of Artificial Sequence: Synthetic oligonucleotide
  Target: AGXT; (-) strand; PAM type: YTN; PAM sequence: CTG
tgctcagacctgcagacggg

SEQ ID NO: 14638 - DNA, 20 bp, Artificial Sequence
  Description of Artificial Sequence: Synthetic oligonucleotide
  Target: AGXT; (-) strand; PAM type: YTN; PAM sequence: CTG
tcctgtgctcagacctgcag

SEQ ID NO: 14639 - DNA, 20 bp, Artificial Sequence
  Description of Artificial Sequence: Synthetic oligonucleotide
  Target: AGXT; (-) strand; PAM type: YTN; PAM sequence: CTC
tgtcctgtgctcagacctgc

SEQ ID NO: 14640 - DNA, 20 bp, Artificial Sequence
  Description of Artificial Sequence: Synthetic oligonucleotide
  Target: AGXT; (-) strand; PAM type: YTN; PAM sequence: CTC
ctctgtcctgtgctcagacc

SEQ ID NO: 14641 - DNA, 20 bp, Artificial Sequence
  Description of Artificial Sequence: Synthetic oligonucleotide
  Target: AGXT; (-) strand; PAM type: YTN; PAM sequence: CTC
tcctctgtcctgtgctcaga

SEQ ID NO: 14642 - DNA, 20 bp, Artificial Sequence
  Description of Artificial Sequence: Synthetic oligonucleotide
  Target: AGXT; (-) strand; PAM type: YTN; PAM sequence: TTC
tctcctctgtcctgtgctca

SEQ ID NO: 14643 - DNA, 20 bp, Artificial Sequence
  Description of Artificial Sequence: Synthetic oligonucleotide
  Target: AGXT; (-) strand; PAM type: YTN; PAM sequence: TTT
ctctcctctgtcctgtgctc

SEQ ID NO: 14644 - DNA, 20 bp, Artificial Sequence
  Description of Artificial Sequence: Synthetic oligonucleotide
  Target: AGXT; (-) strand; PAM type: YTN; PAM sequence: CTG
gccgtggagtttctctcctc

SEQ ID NO: 14645 - DNA, 20 bp, Artificial Sequence
  Description of Artificial Sequence: Synthetic oligonucleotide
  Target: AGXT; (-) strand; PAM type: YTN; PAM sequence: CTC
cctggccgtggagtttctct

SEQ ID NO: 14646 - DNA, 20 bp, Artificial Sequence
  Description of Artificial Sequence: Synthetic oligonucleotide
  Target: AGXT; (-) strand; PAM type: YTN; PAM sequence: CTG
tcagaaggaccctccctggc

SEQ ID NO: 14647 - DNA, 20 bp, Artificial Sequence
  Description of Artificial Sequence: Synthetic oligonucleotide
  Target: AGXT; (-) strand; PAM type: YTN; PAM sequence: CTG
ggggccctgtcagaaggacc

SEQ ID NO: 14648 - DNA, 20 bp, Artificial Sequence
  Description of Artificial Sequence: Synthetic oligonucleotide
  Target: AGXT; (-) strand; PAM type: YTN; PAM sequence: CTG
ggctgggggccctgtcagaa

SEQ ID NO: 14649 - DNA, 20 bp, Artificial Sequence
  Description of Artificial Sequence: Synthetic oligonucleotide
  Target: AGXT; (-) strand; PAM type: YTN; PAM sequence: CTG
tctgggctgggggccctgtc

SEQ ID NO: 14650 - DNA, 20 bp, Artificial Sequence
  Description of Artificial Sequence: Synthetic oligonucleotide
  Target: AGXT; (-) strand; PAM type: YTN; PAM sequence: TTC
atggccacggtccatgcagc

SEQ ID NO: 14651 - DNA, 20 bp, Artificial Sequence
  Description of Artificial Sequence: Synthetic oligonucleotide
  Target: AGXT; (-) strand; PAM type: YTN; PAM sequence: TTA
ttcatggccacggtccatgc

SEQ ID NO: 14652 - DNA, 20 bp, Artificial Sequence
  Description of Artificial Sequence: Synthetic oligonucleotide
  Target: AGXT; (-) strand; PAM type: YTN; PAM sequence: TTT
attcatggccacggtccatg

SEQ ID NO: 14653 - DNA, 20 bp, Artificial Sequence
  Description of Artificial Sequence: Synthetic oligonucleotide
  Target: AGXT; (-) strand; PAM type: YTN; PAM sequence: CTT
tattcatggccacggtccat

SEQ ID NO: 14654 - DNA, 20 bp, Artificial Sequence
  Description of Artificial Sequence: Synthetic oligonucleotide
  Target: AGXT; (-) strand; PAM type: YTN; PAM sequence: TTG
tgagctttattcatggccac

SEQ ID NO: 14655 - DNA, 20 bp, Artificial Sequence
  Description of Artificial Sequence: Synthetic oligonucleotide
  Target: AGXT; (-) strand; PAM type: YTN; PAM sequence: TTT
gtgagctttattcatggcca

SEQ ID NO: 14656 - DNA, 20 bp, Artificial Sequence
  Description of Artificial Sequence: Synthetic oligonucleotide
  Target: AGXT; (-) strand; PAM type: YTN; PAM sequence: TTA
tgtttgtgagctttattcat

SEQ ID NO: 14657 - DNA, 20 bp, Artificial Sequence
  Description of Artificial Sequence: Synthetic oligonucleotide
  Target: AGXT; (-) strand; PAM type: YTN; PAM sequence: CTG
gccaggttatgtttgtgagc

SEQ ID NO: 14658 - DNA, 20 bp, Artificial Sequence
  Description of Artificial Sequence: Synthetic oligonucleotide
  Target: AGXT; (-) strand; PAM type: YTN; PAM sequence: CTG
aagctggccaggttatgttt

SEQ ID NO: 14659 - DNA, 20 bp, Artificial Sequence
  Description of Artificial Sequence: Synthetic oligonucleotide
  Target: AGXT; (-) strand; PAM type: YTN; PAM sequence: TTG
ctgaagctggccaggttatg

SEQ ID NO: 14660 - DNA, 20 bp, Artificial Sequence
  Description of Artificial Sequence: Synthetic oligonucleotide
  Target: AGXT; (-) strand; PAM type: YTN; PAM sequence: CTG
ggtgttgctgaagctggcca

SEQ ID NO: 14661 - DNA, 20 bp, Artificial Sequence
  Description of Artificial Sequence: Synthetic oligonucleotide
  Target: AGXT; (-) strand; PAM type: YTN; PAM sequence: CTG
gccgcaggtggggatggcct

SEQ ID NO: 14662 - DNA, 20 bp, Artificial Sequence
  Description of Artificial Sequence: Synthetic oligonucleotide
  Target: AGXT; (-) strand; PAM type: YTN; PAM sequence: CTC
gtgctggccgcaggtgggga

SEQ ID NO: 14663 - DNA, 20 bp, Artificial Sequence
  Description of Artificial Sequence: Synthetic oligonucleotide
  Target: AGXT; (-) strand; PAM type: YTN; PAM sequence: TTA
taaagaaaaaagagacacag

SEQ ID NO: 14664 - DNA, 20 bp, Artificial Sequence
  Description of Artificial Sequence: Synthetic oligonucleotide
  Target: AGXT; (-) strand; PAM type: YTN; PAM sequence: CTT
ataaagaaaaaagagacaca

SEQ ID NO: 14665 - DNA, 20 bp, Artificial Sequence
  Description of Artificial Sequence: Synthetic oligonucleotide
  Target: AGXT; (-) strand; PAM type: YTN; PAM sequence: TTC
ttataaagaaaaaagagaca

SEQ ID NO: 14666 - DNA, 20 bp, Artificial Sequence
  Description of Artificial Sequence: Synthetic oligonucleotide
  Target: AGXT; (-) strand; PAM type: YTN; PAM sequence: TTT
cttataaagaaaaaagagac

SEQ ID NO: 14667 - DNA, 20 bp, Artificial Sequence
  Description of Artificial Sequence: Synthetic oligonucleotide
  Target: AGXT; (-) strand; PAM type: YTN; PAM sequence: TTT
tcttataaagaaaaaagaga

SEQ ID NO: 14668 - DNA, 20 bp, Artificial Sequence
  Description of Artificial Sequence: Synthetic oligonucleotide
  Target: AGXT; (-) strand; PAM type: YTN; PAM sequence: CTC
caggttttcttataaagaaa

SEQ ID NO: 14669 - DNA, 20 bp, Artificial Sequence
  Description of Artificial Sequence: Synthetic oligonucleotide
  Target: AGXT; (-) strand; PAM type: YTN; PAM sequence: CTC
cacctccaggttttcttata

SEQ ID NO: 14670 - DNA, 20 bp, Artificial Sequence
  Description of Artificial Sequence: Synthetic oligonucleotide
  Target: AGXT; (-) strand; PAM type: YTN; PAM sequence: CTC
ctccacctccaggttttctt

SEQ ID NO: 14671 - DNA, 20 bp, Artificial Sequence
  Description of Artificial Sequence: Synthetic oligonucleotide
  Target: AGXT; (-) strand; PAM type: YTN; PAM sequence: CTC
accctcctccacctccaggt

SEQ ID NO: 14672 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccacctccag

SEQ ID NO: 14673 - DNA, 20 bp, Artificial Sequence
  Description of Artificial Sequence: Synthetic oligonucleotide
  Target: AGXT; (-) strand; PAM type: YTN; PAM sequence: TTC
acaaactctcaccctcctcc

SEQ ID NO: 14674 - DNA, 20 bp, Artificial Sequence
  Description of Artificial Sequence: Synthetic oligonucleotide
  Target: AGXT; (-) strand; PAM type: YTN; PAM sequence: CTC
catgttcacaaactctcacc

SEQ ID NO: 14675 - DNA, 20 bp, Artificial Sequence
  Description of Artificial Sequence: Synthetic oligonucleotide
  Target: AGXT; (-) strand; PAM type: YTN; PAM sequence: CTC
cgcctccatgttcacaaact

SEQ ID NO: 14676 - DNA, 20 bp, Artificial Sequence
  Description of Artificial Sequence: Synthetic oligonucleotide
  Target: AGXT; (-) strand; PAM type: YTN; PAM sequence: CTC
ctccgcctccatgttcacaa

SEQ ID NO: 14677 - DNA, 20 bp, Artificial Sequence
  Description of Artificial Sequence: Synthetic oligonucleotide
  Target: AGXT; (-) strand; PAM type: YTN; PAM sequence: CTC
accctcctccgcctccatgt

SEQ ID NO: 14678 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccgcctccat

SEQ ID NO: 14679 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14680 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14681 - DNA, 20 bp, Artificial Sequence
  Description of Artificial Sequence: Synthetic oligonucleotide
  Target: AGXT; (-) strand; PAM type: YTN; PAM sequence: CTC
cgcctgcatgttcacgaact

SEQ ID NO: 14682 - DNA, 20 bp, Artificial Sequence
  Description of Artificial Sequence: Synthetic oligonucleotide
  Target: AGXT; (-) strand; PAM type: YTN; PAM sequence: CTC
ctccgcctgcatgttcacga

SEQ ID NO: 14683 - DNA, 20 bp, Artificial Sequence
  Description of Artificial Sequence: Synthetic oligonucleotide
  Target: AGXT; (-) strand; PAM type: YTN; PAM sequence: CTC
accctcctccgcctgcatgt

SEQ ID NO: 14684 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccgcctgcat

SEQ ID NO: 14685 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14686 - DNA, 20 bp, Artificial Sequence
  Description of Artificial Sequence: Synthetic oligonucleotide
  Target: AGXT; (-) strand; PAM type: YTN; PAM sequence: CTA
catgttcacgaactctcacc

SEQ ID NO: 14687 - DNA, 20 bp, Artificial Sequence
  Description of Artificial Sequence: Synthetic oligonucleotide
  Target: AGXT; (-) strand; PAM type: YTN; PAM sequence: CTC
cacctacatgttcacgaact

SEQ ID NO: 14688 - DNA, 20 bp, Artificial Sequence
  Description of Artificial Sequence: Synthetic oligonucleotide
  Target: AGXT; (-) strand; PAM type: YTN; PAM sequence: CTC
ctccacctacatgttcacga

SEQ ID NO: 14689 - DNA, 20 bp, Artificial Sequence
  Description of Artificial Sequence: Synthetic oligonucleotide
  Target: AGXT; (-) strand; PAM type: YTN; PAM sequence: TTA
tcctcctccacctacatgtt

SEQ ID NO: 14690 - DNA, 20 bp, Artificial Sequence
  Description of Artificial Sequence: Synthetic oligonucleotide
  Target: AGXT; (-) strand; PAM type: YTN; PAM sequence: CTT
atcctcctccacctacatgt

SEQ ID NO: 14691 - DNA, 20 bp, Artificial Sequence
  Description of Artificial Sequence: Synthetic oligonucleotide
  Target: AGXT; (-) strand; PAM type: YTN; PAM sequence: CTC
ttatcctcctccacctacat

SEQ ID NO: 14692 - DNA, 20 bp, Artificial Sequence
  Description of Artificial Sequence: Synthetic oligonucleotide
  Target: AGXT; (-) strand; PAM type: YTN; PAM sequence: TTC
acgaactcttatcctcctcc

SEQ ID NO: 14693 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactcttatc

SEQ ID NO: 14694 - DNA, 20 bp, Artificial Sequence
  Description of Artificial Sequence: Synthetic oligonucleotide
  Target: AGXT; (-) strand; PAM type: YTN; PAM sequence: CTC
ctgcatgttcacgaactctt

SEQ ID NO: 14695 - DNA, 20 bp, Artificial Sequence
  Description of Artificial Sequence: Synthetic oligonucleotide
  Target: AGXT; (-) strand; PAM type: YTN; PAM sequence: CTC
ctcctgcatgttcacgaact

SEQ ID NO: 14696 - DNA, 20 bp, Artificial Sequence
  Description of Artificial Sequence: Synthetic oligonucleotide
  Target: AGXT; (-) strand; PAM type: YTN; PAM sequence: CTC
accctcctcctgcatgttca

SEQ ID NO: 14697 - DNA, 20 bp, Artificial Sequence
  Description of Artificial Sequence: Synthetic oligonucleotide
  Target: AGXT; (-) strand; PAM type: YTN; PAM sequence: CTC
tcaccctcctcctgcatgtt

SEQ ID NO: 14698 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14699 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14700 - DNA, 20 bp, Artificial Sequence
  Description of Artificial Sequence: Synthetic oligonucleotide
  Target: AGXT; (-) strand; PAM type: YTN; PAM sequence: CTC
ctgcatgttcacgaactctc

SEQ ID NO: 14701 - DNA, 20 bp, Artificial Sequence
  Description of Artificial Sequence: Synthetic oligonucleotide
  Target: AGXT; (-) strand; PAM type: YTN; PAM sequence: CTC
ctcctgcatgttcacgaact

SEQ ID NO: 14702 - DNA, 20 bp, Artificial Sequence
  Description of Artificial Sequence: Synthetic oligonucleotide
  Target: AGXT; (-) strand; PAM type: YTN; PAM sequence: CTC
ctcctcctgcatgttcacga

SEQ ID NO: 14703 - DNA, 20 bp, Artificial Sequence
  Description of Artificial Sequence: Synthetic oligonucleotide
  Target: AGXT; (-) strand; PAM type: YTN; PAM sequence: CTC
accctcctcctcctgcatgt

SEQ ID NO: 14704 - DNA, 20 bp, Artificial Sequence
  Description of Artificial Sequence: Synthetic oligonucleotide
  Target: AGXT; (-) strand; PAM type: YTN; PAM sequence: CTC
tcaccctcctcctcctgcat

SEQ ID NO: 14705 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14706 - DNA, 20 bp, Artificial Sequence
  Description of Artificial Sequence: Synthetic oligonucleotide
  Target: AGXT; (-) strand; PAM type: YTN; PAM sequence: CTC
catgttcacgaactctcacc

SEQ ID NO: 14707 - DNA, 20 bp, Artificial Sequence
  Description of Artificial Sequence: Synthetic oligonucleotide
  Target: AGXT; (-) strand; PAM type: YTN; PAM sequence: CTC
ctccatgttcacgaactctc

SEQ ID NO: 14708 - DNA, 20 bp, Artificial Sequence
  Description of Artificial Sequence: Synthetic oligonucleotide
  Target: AGXT; (-) strand; PAM type: YTN; PAM sequence: CTC
ctcctccatgttcacgaact

SEQ ID NO: 14709 - DNA, 20 bp, Artificial Sequence
  Description of Artificial Sequence: Synthetic oligonucleotide
  Target: AGXT; (-) strand; PAM type: YTN; PAM sequence: CTC
ctcctcctccatgttcacga

SEQ ID NO: 14710 - DNA, 20 bp, Artificial Sequence
  Description of Artificial Sequence: Synthetic oligonucleotide
  Target: AGXT; (-) strand; PAM type: YTN; PAM sequence: CTC
accctcctcctcctccatgt

SEQ ID NO: 14711 - DNA, 20 bp, Artificial Sequence
  Description of Artificial Sequence: Synthetic oligonucleotide
  Target: AGXT; (-) strand; PAM type: YTN; PAM sequence: CTC
tcaccctcctcctcctccat

SEQ ID NO: 14712 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14713 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14714 - DNA, 20 bp, Artificial Sequence
  Description of Artificial Sequence: Synthetic oligonucleotide
  Target: AGXT; (-) strand; PAM type: YTN; PAM sequence: CTC
cgcctgcatgttcacgaact

SEQ ID NO: 14715 - DNA, 20 bp, Artificial Sequence
  Description of Artificial Sequence: Synthetic oligonucleotide
  Target: AGXT; (-) strand; PAM type: YTN; PAM sequence: CTC
ctccgcctgcatgttcacga

SEQ ID NO: 14716 - DNA, 20 bp, Artificial Sequence
  Description of Artificial Sequence: Synthetic oligonucleotide
  Target: AGXT; (-) strand; PAM type: YTN; PAM sequence: CTC
accctcctccgcctgcatgt

SEQ ID NO: 14717 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccgcctgcat

SEQ ID NO: 14718 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14719 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14720 - DNA, 20 bp, Artificial Sequence
  Description of Artificial Sequence: Synthetic oligonucleotide
  Target: AGXT; (-) strand; PAM type: YTN; PAM sequence: CTC
cacctgcatgttcacgaact

SEQ ID NO: 14721 - DNA, 20 bp, Artificial Sequence
  Description of Artificial Sequence: Synthetic oligonucleotide
  Target: AGXT; (-) strand; PAM type: YTN; PAM sequence: CTC
ctccacctgcatgttcacga

SEQ ID NO: 14722 - DNA, 20 bp, Artificial Sequence
  Description of Artificial Sequence: Synthetic oligonucleotide
  Target: AGXT; (-) strand; PAM type: YTN; PAM sequence: CTC
accctcctccacctgcatgt

SEQ ID NO: 14723 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccacctgcat

SEQ ID NO: 14724 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14725 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14726 - DNA, 20 bp, Artificial Sequence
  Description of Artificial Sequence: Synthetic oligonucleotide
  Target: AGXT; (-) strand; PAM type: YTN; PAM sequence: CTC
ctgcatgttcacgaactctc

SEQ ID NO: 14727 - DNA, 20 bp, Artificial Sequence
  Description of Artificial Sequence: Synthetic oligonucleotide
  Target: AGXT; (-) strand; PAM type: YTN; PAM sequence: CTC
ctcctgcatgttcacgaact

SEQ ID NO: 14728 - DNA, 20 bp, Artificial Sequence
  Description of Artificial Sequence: Synthetic oligonucleotide
  Target: AGXT; (-) strand; PAM type: YTN; PAM sequence: CTC
accctcctcctgcatgttca

SEQ ID NO: 14729 - DNA, 20 bp, Artificial Sequence
  Description of Artificial Sequence: Synthetic oligonucleotide
  Target: AGXT; (-) strand; PAM type: YTN; PAM sequence: CTC
tcaccctcctcctgcatgtt

SEQ ID NO: 14730 - DNA, 20 bp, Artificial Sequence
  Description of Artificial Sequence: Synthetic oligonucleotide
  Target: AGXT; (-) strand; PAM type: YTN; PAM sequence: TTC
acgaactctcaccctcctcc

SEQ ID NO: 14731 - DNA, 20 bp, Artificial Sequence
  Description of Artificial Sequence: Synthetic oligonucleotide
  Target: AGXT; (-) strand; PAM type: YTN; PAM sequence: CTG
catgttcacgaactctcacc

SEQ ID NO: 14732 - DNA, 20 bp, Artificial Sequence
  Description of Artificial Sequence: Synthetic oligonucleotide
  Target: AGXT; (-) strand; PAM type: YTN; PAM sequence: CTC
ctgcatgttcacgaactctc

SEQ ID NO: 14733 - DNA, 20 bp, Artificial Sequence
  Description of Artificial Sequence: Synthetic oligonucleotide
  Target: AGXT; (-) strand; PAM type: YTN; PAM sequence: CTC
ctcctgcatgttcacgaact

SEQ ID NO: 14734 - DNA, 20 bp, Artificial Sequence
  Description of Artificial Sequence: Synthetic oligonucleotide
  Target: AGXT; (-) strand; PAM type: YTN; PAM sequence: CTC
ctcctcctgcatgttcacga

SEQ ID NO: 14735 - DNA, 20 bp, Artificial Sequence
  Description of Artificial Sequence: Synthetic oligonucleotide
  Target: AGXT; (-) strand; PAM type: YTN; PAM sequence: CTC
gccctcctcctcctgcatgt

SEQ ID NO: 14736 - DNA, 20 bp, Artificial Sequence
  Description of Artificial Sequence: Synthetic oligonucleotide
  Target: AGXT; (-) strand; PAM type: YTN; PAM sequence: CTC
tcgccctcctcctcctgcat

SEQ ID NO: 14737 - DNA, 20 bp, Artificial Sequence
  Description of Artificial Sequence: Synthetic oligonucleotide
  Target: AGXT; (-) strand; PAM type: YTN; PAM sequence: TTC
acgaactctcgccctcctcc

SEQ ID NO: 14738 - DNA, 20 bp, Artificial Sequence
  Description of Artificial Sequence: Synthetic oligonucleotide
  Target: AGXT; (-) strand; PAM type: YTN; PAM sequence: CTC
catgttcacgaactctcgcc

SEQ ID NO: 14739 - DNA, 20 bp, Artificial Sequence
  Description of Artificial Sequence: Synthetic oligonucleotide
  Target: AGXT; (-) strand; PAM type: YTN; PAM sequence: CTC
cgcctccatgttcacgaact

SEQ ID NO: 14740 - DNA, 20 bp, Artificial Sequence
  Description of Artificial Sequence: Synthetic oligonucleotide
  Target: AGXT; (-) strand; PAM type: YTN; PAM sequence: CTC
ctccgcctccatgttcacga

SEQ ID NO: 14741 - DNA, 20 bp, Artificial Sequence
  Description of Artificial Sequence: Synthetic oligonucleotide
  Target: AGXT; (-) strand; PAM type: YTN; PAM sequence: CTC
accctcctccgcctccatgt

SEQ ID NO: 14742 - DNA, 20 bp, Artificial Sequence
  Description of Artificial Sequence: Synthetic oligonucleotide
  Target: AGXT; (-) strand; PAM type: YTN; PAM sequence: CTC
tcaccctcctccgcctccat

SEQ ID NO: 14743 - DNA, 20 bp, Artificial Sequence
  Description of Artificial Sequence: Synthetic oligonucleotide
  Target: AGXT; (-) strand; PAM type: YTN; PAM sequence: CTA
ggccagaggggacagagtcc

SEQ ID NO: 14744 - DNA, 20 bp, Artificial Sequence
  Description of Artificial Sequence: Synthetic oligonucleotide
  Target: AGXT; (-) strand; PAM type: YTN; PAM sequence: CTG
gccagaatctaggccagagg

SEQ ID NO: 14745 - DNA, 20 bp, Artificial Sequence
  Description of Artificial Sequence: Synthetic oligonucleotide
  Target: AGXT; (-) strand; PAM type: YTN; PAM sequence: CTC
ggcccagccactggccagaa

SEQ ID NO: 14746 - DNA, 20 bp, Artificial Sequence
  Description of Artificial Sequence: Synthetic oligonucleotide
  Target: AGXT; (-) strand; PAM type: YTN; PAM sequence: CTG
ctcggcccagccactggcca

SEQ ID NO: 14747 - DNA, 20 bp, Artificial Sequence
  Description of Artificial Sequence: Synthetic oligonucleotide
  Target: AGXT; (-) strand; PAM type: YTN; PAM sequence: CTG
ccaacagctgctcggcccag

SEQ ID NO: 14748 - DNA, 20 bp, Artificial Sequence
  Description of Artificial Sequence: Synthetic oligonucleotide
  Target: AGXT; (-) strand; PAM type: YTN; PAM sequence: CTC
tgccaacagctgctcggccc

SEQ ID NO: 14749 - DNA, 20 bp, Artificial Sequence
  Description of Artificial Sequence: Synthetic oligonucleotide
  Target: AGXT; (-) strand; PAM type: YTN; PAM sequence: CTA
cctctgccaacagctgctcg

SEQ ID NO: 14750 - DNA, 20 bp, Artificial Sequence
  Description of Artificial Sequence: Synthetic oligonucleotide
  Target: AGXT; (-) strand; PAM type: YTN; PAM sequence: CTG
ggcctacctctgccaacagc

SEQ ID NO: 14751 - DNA, 20 bp, Artificial Sequence
  Description of Artificial Sequence: Synthetic oligonucleotide
  Target: AGXT; (-) strand; PAM type: YTN; PAM sequence: CTG
tgtggaccccagggaccagg

SEQ ID NO: 14752 - DNA, 20 bp, Artificial Sequence
  Description of Artificial Sequence: Synthetic oligonucleotide
  Target: AGXT; (-) strand; PAM type: YTN; PAM sequence: CTG
agggcctgtgtggaccccag

SEQ ID NO: 14753 - DNA, 20 bp, Artificial Sequence
  Description of Artificial Sequence: Synthetic oligonucleotide
  Target: AGXT; (-) strand; PAM type: YTN; PAM sequence: TTC
ccagggacagcgggtgcctg

SEQ ID NO: 14754 - DNA, 20 bp, Artificial Sequence
  Description of Artificial Sequence: Synthetic oligonucleotide
  Target: AGXT; (-) strand; PAM type: YTN; PAM sequence: CTG
tggttcccagggacagcggg

SEQ ID NO: 14755 - DNA, 20 bp, Artificial Sequence
  Description of Artificial Sequence: Synthetic oligonucleotide
  Target: AGXT; (-) strand; PAM type: YTN; PAM sequence: CTG
aagagggtcagccgggcagt

SEQ ID NO: 14756 - DNA, 20 bp, Artificial Sequence
  Description of Artificial Sequence: Synthetic oligonucleotide
  Target: AGXT; (-) strand; PAM type: YTN; PAM sequence: CTG
cagggcccggcagtggtgct

SEQ ID NO: 14757 - DNA, 20 bp, Artificial Sequence
  Description of Artificial Sequence: Synthetic oligonucleotide
  Target: AGXT; (-) strand; PAM type: YTN; PAM sequence: CTG
gtgagacccagctgcagggc

SEQ ID NO: 14758 - DNA, 20 bp, Artificial Sequence
  Description of Artificial Sequence: Synthetic oligonucleotide
  Target: AGXT; (-) strand; PAM type: YTN; PAM sequence: CTG
ggggagtgagggagcatcac

SEQ ID NO: 14759 - DNA, 20 bp, Artificial Sequence
  Description of Artificial Sequence: Synthetic oligonucleotide
  Target: AGXT; (-) strand; PAM type: YTN; PAM sequence: TTG
gagcagagggagctggggga

SEQ ID NO: 14760 - DNA, 20 bp, Artificial Sequence
  Description of Artificial Sequence: Synthetic oligonucleotide
  Target: AGXT; (-) strand; PAM type: YTN; PAM sequence: CTG
aacattggagcagagggagc

SEQ ID NO: 14761 - DNA, 20 bp, Artificial Sequence
  Description of Artificial Sequence: Synthetic oligonucleotide
  Target: AGXT; (-) strand; PAM type: YTN; PAM sequence: CTC
agccctgaacattggagcag

SEQ ID NO: 14762 - DNA, 20 bp, Artificial Sequence
  Description of Artificial Sequence: Synthetic oligonucleotide
  Target: AGXT; (-) strand; PAM type: YTN; PAM sequence: TTC
tcagccctgaacattggagc

SEQ ID NO: 14763 - DNA, 20 bp, Artificial Sequence
  Description of Artificial Sequence: Synthetic oligonucleotide
  Target: AGXT; (-) strand; PAM type: YTN; PAM sequence: TTT
ctcagccctgaacattggag

SEQ ID NO: 14764 - DNA, 20 bp, Artificial Sequence
  Description of Artificial Sequence: Synthetic oligonucleotide
  Target: AGXT; (-) strand; PAM type: YTN; PAM sequence: CTT
tctcagccctgaacattgga

SEQ ID NO: 14765 - DNA, 20 bp, Artificial Sequence
  Description of Artificial Sequence: Synthetic oligonucleotide
  Target: AGXT; (-) strand; PAM type: YTN; PAM sequence: TTC
ctttctcagccctgaacatt

SEQ ID NO: 14766 - DNA, 20 bp, Artificial Sequence
  Description of Artificial Sequence: Synthetic oligonucleotide
  Target: AGXT; (-) strand; PAM type: YTN; PAM sequence: CTT
cctttctcagccctgaacat

SEQ ID NO: 14767 - DNA, 20 bp, Artificial Sequence
  Description of Artificial Sequence: Synthetic oligonucleotide
  Target: AGXT; (-) strand; PAM type: YTN; PAM sequence: CTC
ttcctttctcagccctgaac

SEQ ID NO: 14768 - DNA, 20 bp, Artificial Sequence
  Description of Artificial Sequence: Synthetic oligonucleotide
  Target: AGXT; (-) strand; PAM type: YTN; PAM sequence: CTG
tggctcttcctttctcagcc

SEQ ID NO: 14769 - DNA, 20 bp, Artificial Sequence
  Description of Artificial Sequence: Synthetic oligonucleotide
  Target: AGXT; (-) strand; PAM type: YTN; PAM sequence: CTG
tcaggatccatcaggacctg

SEQ ID NO: 14770 - DNA, 20 bp, Artificial Sequence
  Description of Artificial Sequence: Synthetic oligonucleotide
  Target: AGXT; (-) strand; PAM type: YTN; PAM sequence: CTG
cctgtcaggatccatcagga

SEQ ID NO: 14771 - DNA, 20 bp, Artificial Sequence
  Description of Artificial Sequence: Synthetic oligonucleotide
  Target: AGXT; (-) strand; PAM type: YTN; PAM sequence: CTC
ctgcctgtcaggatccatca

SEQ ID NO: 14772 - DNA, 20 bp, Artificial Sequence
  Description of Artificial Sequence: Synthetic oligonucleotide
  Target: AGXT; (-) strand; PAM type: YTN; PAM sequence: TTC
tcctgcctgtcaggatccat

SEQ ID NO: 14773 - DNA, 20 bp, Artificial Sequence
  Description of Artificial Sequence: Synthetic oligonucleotide
  Target: AGXT; (-) strand; PAM type: YTN; PAM sequence: CTT
ctcctgcctgtcaggatcca

SEQ ID NO: 14774 - DNA, 20 bp, Artificial Sequence
  Description of Artificial Sequence: Synthetic oligonucleotide
  Target: AGXT; (-) strand; PAM type: YTN; PAM sequence: TTG
ccttctcctgcctgtcagga

SEQ ID NO: 14775 - DNA, 20 bp, Artificial Sequence
  Description of Artificial Sequence: Synthetic oligonucleotide
  Target: AGXT; (-) strand; PAM type: YTN; PAM sequence: TTG
gccagttgccttctcctgcc

SEQ ID NO: 14776 - DNA, 20 bp, Artificial Sequence
  Description of Artificial Sequence: Synthetic oligonucleotide
  Target: AGXT; (-) strand; PAM type: YTN; PAM sequence: CTC
caccccaggagttggccagt

SEQ ID NO: 14777 - DNA, 20 bp, Artificial Sequence
  Description of Artificial Sequence: Synthetic oligonucleotide
  Target: AGXT; (-) strand; PAM type: YTN; PAM sequence: CTC
ccacctccaccccaggagtt

SEQ ID NO: 14778 - DNA, 20 bp, Artificial Sequence
  Description of Artificial Sequence: Synthetic oligonucleotide
  Target: AGXT; (-) strand; PAM type: YTN; PAM sequence: CTG
gcaaggaaggcagggcacct

SEQ ID NO: 14779 - DNA, 20 bp, Artificial Sequence
  Description of Artificial Sequence: Synthetic oligonucleotide
  Target: AGXT; (-) strand; PAM type: YTN; PAM sequence: CTC
aggctggcaaggaaggcagg

SEQ ID NO: 14780 - DNA, 20 bp, Artificial Sequence
  Description of Artificial Sequence: Synthetic oligonucleotide
  Target: AGXT; (-) strand; PAM type: YTN; PAM sequence: CTG
agcctcaggctggcaaggaa

SEQ ID NO: 14781 - DNA, 20 bp, Artificial Sequence
  Description of Artificial Sequence: Synthetic oligonucleotide
  Target: AGXT; (-) strand; PAM type: YTN; PAM sequence: TTC
tgagcctcaggctggcaagg

SEQ ID NO: 14782 - DNA, 20 bp, Artificial Sequence
  Description of Artificial Sequence: Synthetic oligonucleotide
  Target: AGXT; (-) strand; PAM type: YTN; PAM sequence: TTT
ctgagcctcaggctggcaag

SEQ ID NO: 14783 - DNA, 20 bp, Artificial Sequence
  Description of Artificial Sequence: Synthetic oligonucleotide
  Target: AGXT; (-) strand; PAM type: YTN; PAM sequence: CTG
gatggggtttctgagcctca

SEQ ID NO: 14784 - DNA, 20 bp, Artificial Sequence
  Description of Artificial Sequence: Synthetic oligonucleotide
  Target: AGXT; (-) strand; PAM type: YTN; PAM sequence: CTG
gccccaggctggatggggtt

SEQ ID NO: 14785 - DNA, 20 bp, Artificial Sequence
  Description of Artificial Sequence: Synthetic oligonucleotide
  Target: AGXT; (-) strand; PAM type: YTN; PAM sequence: CTG
gagggcctggccccaggctg

SEQ ID NO: 14786 - DNA, 20 bp, Artificial Sequence
  Description of Artificial Sequence: Synthetic oligonucleotide
  Target: AGXT; (-) strand; PAM type: YTN; PAM sequence: CTG
gagaggtgggggacagaatg

SEQ ID NO: 14787 - DNA, 20 bp, Artificial Sequence
  Description of Artificial Sequence: Synthetic oligonucleotide
  Target: AGXT; (-) strand; PAM type: YTN; PAM sequence: TTG
tacctggagaggtgggggac

SEQ ID NO: 14788 - DNA, 20 bp, Artificial Sequence
  Description of Artificial Sequence: Synthetic oligonucleotide
  Target: AGXT; (-) strand; PAM type: YTN; PAM sequence: CTT
gtacctggagaggtggggga

SEQ ID NO: 14789 - DNA, 20 bp, Artificial Sequence
  Description of Artificial Sequence: Synthetic oligonucleotide
  Target: AGXT; (-) strand; PAM type: YTN; PAM sequence: TTG
ccggtccatgtaaagggggg

SEQ ID NO: 14790 - DNA, 20 bp, Artificial Sequence
  Description of Artificial Sequence: Synthetic oligonucleotide
  Target: AGXT; (-) strand; PAM type: YTN; PAM sequence: CTT
gccggtccatgtaaaggggg

SEQ ID NO: 14791 - DNA, 20 bp, Artificial Sequence
  Description of Artificial Sequence: Synthetic oligonucleotide
  Target: AGXT; (-) strand; PAM type: YTN; PAM sequence: TTA
ccttgccggtccatgtaaag

SEQ ID NO: 14792 - DNA, 20 bp, Artificial Sequence
  Description of Artificial Sequence: Synthetic oligonucleotide
  Target: AGXT; (-) strand; PAM type: YTN; PAM sequence: CTT
accttgccggtccatgtaaa

SEQ ID NO: 14793 - DNA, 20 bp, Artificial Sequence
  Description of Artificial Sequence: Synthetic oligonucleotide
  Target: AGXT; (-) strand; PAM type: YTN; PAM sequence: CTC
agagcccacccttaccttgc

SEQ ID NO: 14794 - DNA, 20 bp, Artificial Sequence
  Description of Artificial Sequence: Synthetic oligonucleotide
  Target: AGXT; (-) strand; PAM type: YTN; PAM sequence: CTC
tcagagcccacccttacctt

SEQ ID NO: 14795 - DNA, 20 bp, Artificial Sequence
  Description of Artificial Sequence: Synthetic oligonucleotide
  Target: AGXT; (-) strand; PAM type: YTN; PAM sequence: CTG
ggtagggctctcagagccca

SEQ ID NO: 14796 - DNA, 20 bp, Artificial Sequence
  Description of Artificial Sequence: Synthetic oligonucleotide
  Target: AGXT; (-) strand; PAM type: YTN; PAM sequence: TTG
ggctgggtagggctctcaga

SEQ ID NO: 14797 - DNA, 20 bp, Artificial Sequence
  Description of Artificial Sequence: Synthetic oligonucleotide
  Target: AGXT; (-) strand; PAM type: YTN; PAM sequence: CTT
gggctgggtagggctctcag

SEQ ID NO: 14798 - DNA, 20 bp, Artificial Sequence
  Description of Artificial Sequence: Synthetic oligonucleotide
  Target: AGXT; (-) strand; PAM type: YTN; PAM sequence: CTG
cttgggctgggtagggctct

SEQ ID NO: 14799 - DNA, 20 bp, Artificial Sequence
  Description of Artificial Sequence: Synthetic oligonucleotide
  Target: AGXT; (-) strand; PAM type: YTN; PAM sequence: CTG
cacgcggagccccaaggctg

SEQ ID NO: 14800 - DNA, 20 bp, Artificial Sequence
  Description of Artificial Sequence: Synthetic oligonucleotide
  Target: AGXT; (-) strand; PAM type: YTN; PAM sequence: TTC
ctgcacgcggagccccaagg

SEQ ID NO: 14801 - DNA, 20 bp, Artificial Sequence
  Description of Artificial Sequence: Synthetic oligonucleotide
  Target: AGXT; (-) strand; PAM type: YTN; PAM sequence: CTT
cctgcacgcggagccccaag

SEQ ID NO: 14802 - DNA, 20 bp, Artificial Sequence
  Description of Artificial Sequence: Synthetic oligonucleotide
  Target: AGXT; (-) strand; PAM type: YTN; PAM sequence: TTC
cagcagggcttcctgcacgc

SEQ ID NO: 14803 - DNA, 20 bp, Artificial Sequence
  Description of Artificial Sequence: Synthetic oligonucleotide
  Target: AGXT; (-) strand; PAM type: YTN; PAM sequence: CTT
ccagcagggcttcctgcacg

SEQ ID NO: 14804 - DNA, 20 bp, Artificial Sequence
  Description of Artificial Sequence: Synthetic oligonucleotide
  Target: AGXT; (-) strand; PAM type: YTN; PAM sequence: CTG
gacgcacgcttccagcaggg

SEQ ID NO: 14805 - DNA, 20 bp, Artificial Sequence
  Description of Artificial Sequence: Synthetic oligonucleotide
  Target: AGXT; (-) strand; PAM type: YTN; PAM sequence: CTG
ctggacgcacgcttccagca

SEQ ID NO: 14806 - DNA, 20 bp, Artificial Sequence
  Description of Artificial Sequence: Synthetic oligonucleotide
  Target: AGXT; (-) strand; PAM type: YTN; PAM sequence: CTG
gtggagatggggccgaatcc

SEQ ID NO: 14807 - DNA, 20 bp, Artificial Sequence
  Description of Artificial Sequence: Synthetic oligonucleotide
  Target: AGXT; (-) strand; PAM type: YTN; PAM sequence: CTG
ggcctggtggagatggggcc

SEQ ID NO: 14808 - DNA, 20 bp, Artificial Sequence
  Description of Artificial Sequence: Synthetic oligonucleotide
  Target: AGXT; (-) strand; PAM type: YTN; PAM sequence: TTC
cctgggcctggtggagatgg

SEQ ID NO: 14809 - DNA, 20 bp, Artificial Sequence
  Description of Artificial Sequence: Synthetic oligonucleotide
  Target: AGXT; (-) strand; PAM type: YTN; PAM sequence: TTT
ccctgggcctggtggagatg

SEQ ID NO: 14810 - DNA, 20 bp, Artificial Sequence
  Description of Artificial Sequence: Synthetic oligonucleotide
  Target: AGXT; (-) strand; PAM type: YTN; PAM sequence: TTG
ccgcagtaaggagtgagtgt

SEQ ID NO: 14811 - DNA, 20 bp, Artificial Sequence
  Description of Artificial Sequence: Synthetic oligonucleotide
  Target: AGXT; (-) strand; PAM type: YTN; PAM sequence: CTT
gccgcagtaaggagtgagtg

SEQ ID NO: 14812 - DNA, 20 bp, Artificial Sequence
  Description of Artificial Sequence: Synthetic oligonucleotide
  Target: AGXT; (-) strand; PAM type: YTN; PAM sequence: CTC
ttgccgcagtaaggagtgag

SEQ ID NO: 14813 - DNA, 20 bp, Artificial Sequence
  Description of Artificial Sequence: Synthetic oligonucleotide
  Target: AGXT; (-) strand; PAM type: YTN; PAM sequence: TTC
atggagccgctcttgccgca

SEQ ID NO: 14814 - DNA, 20 bp, Artificial Sequence
  Description of Artificial Sequence: Synthetic oligonucleotide
  Target: AGXT; (-) strand; PAM type: YTN; PAM sequence: CTG
ggtagttcatggagccgctc

SEQ ID NO: 14815 - DNA, 20 bp, Artificial Sequence
  Description of Artificial Sequence: Synthetic oligonucleotide
  Target: AGXT; (-) strand; PAM type: YTN; PAM sequence: CTG
gggtgctgggtagttcatgg

SEQ ID NO: 14816 - DNA, 20 bp, Artificial Sequence
  Description of Artificial Sequence: Synthetic oligonucleotide
  Target: AGXT; (-) strand; PAM type: YTN; PAM sequence: CTC
agtggaaacactggggtgct

SEQ ID NO: 14817 - DNA, 20 bp, Artificial Sequence
  Description of Artificial Sequence: Synthetic oligonucleotide
  Target: AGXT; (-) strand; PAM type: YTN; PAM sequence: CTG
aaagctcagtggaaacactg

SEQ ID NO: 14818 - DNA, 20 bp, Artificial Sequence
  Description of Artificial Sequence: Synthetic oligonucleotide
  Target: AGXT; (-) strand; PAM type: YTN; PAM sequence: CTG
gatctgaaagctcagtggaa

SEQ ID NO: 14819 - DNA, 20 bp, Artificial Sequence
  Description of Artificial Sequence: Synthetic oligonucleotide
  Target: AGXT; (-) strand; PAM type: YTN; PAM sequence: CTG
ccagtccccacgcctggatc

SEQ ID NO: 14820 - DNA, 20 bp, Artificial Sequence
  Description of Artificial Sequence: Synthetic oligonucleotide
  Target: AGXT; (-) strand; PAM type: YTN; PAM sequence: CTC
ctgccagtccccacgcctgg

SEQ ID NO: 14821 - DNA, 20 bp, Artificial Sequence
  Description of Artificial Sequence: Synthetic oligonucleotide
  Target: AGXT; (-) strand; PAM type: YTN; PAM sequence: CTG
tccctcctgccagtccccac

SEQ ID NO: 14822 - DNA, 20 bp, Artificial Sequence
  Description of Artificial Sequence: Synthetic oligonucleotide
  Target: AGXT; (-) strand; PAM type: YTN; PAM sequence: CTC
aaatgtcccccaccagaagc

SEQ ID NO: 14823 - DNA, 20 bp, Artificial Sequence
  Description of Artificial Sequence: Synthetic oligonucleotide
  Target: AGXT; (-) strand; PAM type: YTN; PAM sequence: CTG
gggcatctcaaatgtccccc

SEQ ID NO: 14824 - DNA, 20 bp, Artificial Sequence
  Description of Artificial Sequence: Synthetic oligonucleotide
  Target: AGXT; (-) strand; PAM type: YTN; PAM sequence: CTC
tggggcatctcaaatgtccc

SEQ ID NO: 14825 - DNA, 20 bp, Artificial Sequence
  Description of Artificial Sequence: Synthetic oligonucleotide
  Target: AGXT; (-) strand; PAM type: YTN; PAM sequence: CTA
cagctctggggcatctcaaa

SEQ ID NO: 14826 - DNA, 20 bp, Artificial Sequence
  Description of Artificial Sequence: Synthetic oligonucleotide
  Target: AGXT; (-) strand; PAM type: YTN; PAM sequence: CTG
ctacagctctggggcatctc

SEQ ID NO: 14827 - DNA, 20 bp, Artificial Sequence
  Description of Artificial Sequence: Synthetic oligonucleotide
  Target: AGXT; (-) strand; PAM type: YTN; PAM sequence: TTC
tgctacagctctggggcatc

SEQ ID NO: 14828 - DNA, 20 bp, Artificial Sequence
  Description of Artificial Sequence: Synthetic oligonucleotide
  Target: AGXT; (-) strand; PAM type: YTN; PAM sequence: CTT
ctgctacagctctggggcat

SEQ ID NO: 14829 - DNA, 20 bp, Artificial Sequence
  Description of Artificial Sequence: Synthetic oligonucleotide
  Target: AGXT; (-) strand; PAM type: YTN; PAM sequence: CTG
cttctgctacagctctgggg

SEQ ID NO: 14830 - DNA, 20 bp, Artificial Sequence
  Description of Artificial Sequence: Synthetic oligonucleotide
  Target: AGXT; (-) strand; PAM type: YTN; PAM sequence: TTC
ccactgcttctgctacagct

SEQ ID NO: 14831 - DNA, 20 bp, Artificial Sequence
  Description of Artificial Sequence: Synthetic oligonucleotide
  Target: AGXT; (-) strand; PAM type: YTN; PAM sequence: CTT
cccactgcttctgctacagc

SEQ ID NO: 14832 - DNA, 20 bp, Artificial Sequence
  Description of Artificial Sequence: Synthetic oligonucleotide
  Target: AGXT; (-) strand; PAM type: YTN; PAM sequence: CTC
ttcccactgcttctgctaca

SEQ ID NO: 14833 - DNA, 20 bp, Artificial Sequence
  Description of Artificial Sequence: Synthetic oligonucleotide
  Target: AGXT; (-) strand; PAM type: YTN; PAM sequence: TTC
ctcttcccactgcttctgct

SEQ ID NO: 14834 - DNA, 20 bp, Artificial Sequence
  Description of Artificial Sequence: Synthetic oligonucleotide
  Target: AGXT; (-) strand; PAM type: YTN; PAM sequence: CTT
cctcttcccactgcttctgc

SEQ ID NO: 14835 - DNA, 20 bp, Artificial Sequence
  Description of Artificial Sequence: Synthetic oligonucleotide
  Target: AGXT; (-) strand; PAM type: YTN; PAM sequence: CTG
gcccttcctcttcccactgc

SEQ ID NO: 14836 - DNA, 20 bp, Artificial Sequence
  Description of Artificial Sequence: Synthetic oligonucleotide
  Target: AGXT; (-) strand; PAM type: YTN; PAM sequence: CTG
gagccctggcccttcctctt

SEQ ID NO: 14837 - DNA, 20 bp, Artificial Sequence
  Description of Artificial Sequence: Synthetic oligonucleotide
  Target: AGXT; (-) strand; PAM type: YTN; PAM sequence: TTG
actggagccctggcccttcc

SEQ ID NO: 14838 - DNA, 20 bp, Artificial Sequence
  Description of Artificial Sequence: Synthetic oligonucleotide
  Target: AGXT; (-) strand; PAM type: YTN; PAM sequence: CTG
attgactggagccctggccc

SEQ ID NO: 14839 - DNA, 20 bp, Artificial Sequence
  Description of Artificial Sequence: Synthetic oligonucleotide
  Target: AGXT; (-) strand; PAM type: YTN; PAM sequence: TTG
ggcagaggggtgcccaacgc

SEQ ID NO: 14840 - DNA, 20 bp, Artificial Sequence
  Description of Artificial Sequence: Synthetic oligonucleotide
  Target: AGXT; (-) strand; PAM type: YTN; PAM sequence: CTG
gggggttgggcagaggggtg

SEQ ID NO: 14841 - DNA, 20 bp, Artificial Sequence
  Description of Artificial Sequence: Synthetic oligonucleotide
  Target: AGXT; (-) strand; PAM type: YTN; PAM sequence: CTC
tggggggttgggcagagggg

SEQ ID NO: 14842 - DNA, 20 bp, Artificial Sequence
  Description of Artificial Sequence: Synthetic oligonucleotide
  Target: AGXT; (-) strand; PAM type: YTN; PAM sequence: CTG
agcctctggggggttgggca

SEQ ID NO: 14843 - DNA, 20 bp, Artificial Sequence
  Description of Artificial Sequence: Synthetic oligonucleotide
  Target: AGXT; (-) strand; PAM type: YTN; PAM sequence: CTG
gcagggcgcagggcagatgt

SEQ ID NO: 14844 - DNA, 20 bp, Artificial Sequence
  Description of Artificial Sequence: Synthetic oligonucleotide
  Target: AGXT; (-) strand; PAM type: YTN; PAM sequence: CTA
tgggcagcctggcagggcgc

SEQ ID NO: 14845 - DNA, 20 bp, Artificial Sequence
  Description of Artificial Sequence: Synthetic oligonucleotide
  Target: AGXT; (-) strand; PAM type: YTN; PAM sequence: CTG
ctatgggcagcctggcaggg

SEQ ID NO: 14846 - DNA, 20 bp, Artificial Sequence
  Description of Artificial Sequence: Synthetic oligonucleotide
  Target: AGXT; (-) strand; PAM type: YTN; PAM sequence: CTC
actgctatgggcagcctggc

SEQ ID NO: 14847 - DNA, 20 bp, Artificial Sequence
  Description of Artificial Sequence: Synthetic oligonucleotide
  Target: AGXT; (-) strand; PAM type: YTN; PAM sequence: CTG
acagtggtgctcactgctat

SEQ ID NO: 14848 - DNA, 20 bp, Artificial Sequence
  Description of Artificial Sequence: Synthetic oligonucleotide
  Target: AGXT; (-) strand; PAM type: YTN; PAM sequence: CTG
cgaggtgaccctgacagtgg

SEQ ID NO: 14849 - DNA, 20 bp, Artificial Sequence
  Description of Artificial Sequence: Synthetic oligonucleotide
  Target: AGXT; (-) strand; PAM type: YTN; PAM sequence: TTC
cctgcgaggtgaccctgaca

SEQ ID NO: 14850 - DNA, 20 bp, Artificial Sequence
  Description of Artificial Sequence: Synthetic oligonucleotide
  Target: AGXT; (-) strand; PAM type: YTN; PAM sequence: TTG
aggttccctgcgaggtgacc

SEQ ID NO: 14851 - DNA, 20 bp, Artificial Sequence
  Description of Artificial Sequence: Synthetic oligonucleotide
  Target: AGXT; (-) strand; PAM type: YTN; PAM sequence: CTG
gttgaggttccctgcgaggt

SEQ ID NO: 14852 - DNA, 20 bp, Artificial Sequence
  Description of Artificial Sequence: Synthetic oligonucleotide
  Target: AGXT; (-) strand; PAM type: YTN; PAM sequence: CTC
ggccggcctggttgaggttc

SEQ ID NO: 14853 - DNA, 20 bp, Artificial Sequence
  Description of Artificial Sequence: Synthetic oligonucleotide
  Target: AGXT; (-) strand; PAM type: YTN; PAM sequence: TTG
gcccctcggccggcctggtt

SEQ ID NO: 14854 - DNA, 20 bp, Artificial Sequence
  Description of Artificial Sequence: Synthetic oligonucleotide
  Target: AGXT; (-) strand; PAM type: YTN; PAM sequence: CTT
ggcccctcggccggcctggt

SEQ ID NO: 14855 - DNA, 20 bp, Artificial Sequence
  Description of Artificial Sequence: Synthetic oligonucleotide
  Target: AGXT; (-) strand; PAM type: YTN; PAM sequence: CTC
cttggcccctcggccggcct

SEQ ID NO: 14856 - DNA, 20 bp, Artificial Sequence
  Description of Artificial Sequence: Synthetic oligonucleotide
  Target: AGXT; (-) strand; PAM type: YTN; PAM sequence: CTC
ccgtaagcggatgggcacag

SEQ ID NO: 14857 - DNA, 20 bp, Artificial Sequence
  Description of Artificial Sequence: Synthetic oligonucleotide
  Target: AGXT; (-) strand; PAM type: YTN; PAM sequence: CTC
tcccgtaagcggatgggcac

SEQ ID NO: 14858 - DNA, 20 bp, Artificial Sequence
  Description of Artificial Sequence: Synthetic oligonucleotide
  Target: AGXT; (-) strand; PAM type: YTN; PAM sequence: CTC
tctcccgtaagcggatgggc

SEQ ID NO: 14859 - DNA, 20 bp, Artificial Sequence
  Description of Artificial Sequence: Synthetic oligonucleotide
  Target: AGXT; (-) strand; PAM type: YTN; PAM sequence: CTC
ccatggagtgggtgggcagg

SEQ ID NO: 14860 - DNA, 20 bp, Artificial Sequence
  Description of Artificial Sequence: Synthetic oligonucleotide
  Target: AGXT; (-) strand; PAM type: YTN; PAM sequence: CTG
cagaaacagacaggctccca

SEQ ID NO: 14861 - DNA, 20 bp, Artificial Sequence
  Description of Artificial Sequence: Synthetic oligonucleotide
  Target: AGXT; (-) strand; PAM type: YTN; PAM sequence: CTC
tgcagaaacagacaggctcc

SEQ ID NO: 14862 - DNA, 20 bp, Artificial Sequence
  Description of Artificial Sequence: Synthetic oligonucleotide
  Target: AGXT; (-) strand; PAM type: YTN; PAM sequence: CTC
ccaaatcaggaggggctctg

SEQ ID NO: 14863 - DNA, 20 bp, Artificial Sequence
  Description of Artificial Sequence: Synthetic oligonucleotide
  Target: AGXT; (-) strand; PAM type: YTN; PAM sequence: CTG
agaactcccaaatcaggagg

SEQ ID NO: 14864 - DNA, 20 bp, Artificial Sequence
  Description of Artificial Sequence: Synthetic oligonucleotide
  Target: AGXT; (-) strand; PAM type: YTN; PAM sequence: CTG
cctgagaactcccaaatcag

SEQ ID NO: 14865 - DNA, 20 bp, Artificial Sequence
  Description of Artificial Sequence: Synthetic oligonucleotide
  Target: AGXT; (-) strand; PAM type: YTN; PAM sequence: TTC
ctgcctgagaactcccaaat

SEQ ID NO: 14866 - DNA, 20 bp, Artificial Sequence
  Description of Artificial Sequence: Synthetic oligonucleotide
  Target: AGXT; (-) strand; PAM type: YTN; PAM sequence: CTT
cctgcctgagaactcccaaa

SEQ ID NO: 14867 - DNA, 20 bp, Artificial Sequence
  Description of Artificial Sequence: Synthetic oligonucleotide
  Target: AGXT; (-) strand; PAM type: YTN; PAM sequence: CTC
ccttcctgcctgagaactcc

SEQ ID NO: 14868 - DNA, 20 bp, Artificial Sequence
  Description of Artificial Sequence: Synthetic oligonucleotide
  Target: AGXT; (-) strand; PAM type: YTN; PAM sequence: TTG
aggatcagcccagaaatccc

SEQ ID NO: 14869 - DNA, 20 bp, Artificial Sequence
  Description of Artificial Sequence: Synthetic oligonucleotide
  Target: AGXT; (-) strand; PAM type: YTN; PAM sequence: TTT
gaggatcagcccagaaatcc

SEQ ID NO: 14870 - DNA, 20 bp, Artificial Sequence
  Description of Artificial Sequence: Synthetic oligonucleotide
  Target: AGXT; (-) strand; PAM type: YTN; PAM sequence: TTC
agtagtagtttgaggatcag

SEQ ID NO: 14871 - DNA, 20 bp, Artificial Sequence
  Description of Artificial Sequence: Synthetic oligonucleotide
  Target: AGXT; (-) strand; PAM type: YTN; PAM sequence: TTT
cagtagtagtttgaggatca

SEQ ID NO: 14872 - DNA, 20 bp, Artificial Sequence
  Description of Artificial Sequence: Synthetic oligonucleotide
  Target: AGXT; (-) strand; PAM type: YTN; PAM sequence: CTT
tcagtagtagtttgaggatc

SEQ ID NO: 14873 - DNA, 20 bp, Artificial Sequence
  Description of Artificial Sequence: Synthetic oligonucleotide
  Target: AGXT; (-) strand; PAM type: YTN; PAM sequence: CTG
ctttcagtagtagtttgagg

SEQ ID NO: 14874 - DNA, 20 bp, Artificial Sequence
  Description of Artificial Sequence: Synthetic oligonucleotide
  Target: AGXT; (-) strand; PAM type: YTN; PAM sequence: CTC
cccaggtccctgctttcagt

SEQ ID NO: 14875 - DNA, 20 bp, Artificial Sequence
  Description of Artificial Sequence: Synthetic oligonucleotide
  Target: AGXT; (-) strand; PAM type: YTN; PAM sequence: CTG
gggccctccccaggtccctg

SEQ ID NO: 14876 - DNA, 20 bp, Artificial Sequence
  Description of Artificial Sequence: Synthetic oligonucleotide
  Target: AGXT; (-) strand; PAM type: YTN; PAM sequence: CTG
ccaccccaggcaccgtgtcc

SEQ ID NO: 14877 - DNA, 20 bp, Artificial Sequence
  Description of Artificial Sequence: Synthetic oligonucleotide
  Target: AGXT; (-) strand; PAM type: YTN; PAM sequence: CTG
gtccccagggacagccctgc

SEQ ID NO: 14878 - DNA, 20 bp, Artificial Sequence
  Description of Artificial Sequence: Synthetic oligonucleotide
  Target: AGXT; (-) strand; PAM type: YTN; PAM sequence: CTG
tgctggtccccagggacagc

SEQ ID NO: 14879 - DNA, 20 bp, Artificial Sequence
  Description of Artificial Sequence: Synthetic oligonucleotide
  Target: AGXT; (-) strand; PAM type: YTN; PAM sequence: CTG
ctgtgctggtccccagggac

SEQ ID NO: 14880 - DNA, 20 bp, Artificial Sequence
  Description of Artificial Sequence: Synthetic oligonucleotide
  Target: AGXT; (-) strand; PAM type: YTN; PAM sequence: CTC
tgctgtgctggtccccaggg

SEQ ID NO: 14881 - DNA, 20 bp, Artificial Sequence
  Description of Artificial Sequence: Synthetic oligonucleotide
  Target: AGXT; (-) strand; PAM type: YTN; PAM sequence: CTC
cctctgctgtgctggtcccc

SEQ ID NO: 14882 - DNA, 20 bp, Artificial Sequence
  Description of Artificial Sequence: Synthetic oligonucleotide
  Target: AGXT; (-) strand; PAM type: YTN; PAM sequence: TTC
tccctctgctgtgctggtcc

SEQ ID NO: 14883 - DNA, 20 bp, Artificial Sequence
  Description of Artificial Sequence: Synthetic oligonucleotide
  Target: AGXT; (-) strand; PAM type: YTN; PAM sequence: CTT
ctccctctgctgtgctggtc

SEQ ID NO: 14884 - DNA, 20 bp, Artificial Sequence
  Description of Artificial Sequence: Synthetic oligonucleotide
  Target: AGXT; (-) strand; PAM type: YTN; PAM sequence: TTA
gcgcagcttctccctctgct

SEQ ID NO: 14885 - DNA, 20 bp, Artificial Sequence
  Description of Artificial Sequence: Synthetic oligonucleotide
  Target: AGXT; (-) strand; PAM type: YTN; PAM sequence: TTT
agcgcagcttctccctctgc

SEQ ID NO: 14886 - DNA, 20 bp, Artificial Sequence
  Description of Artificial Sequence: Synthetic oligonucleotide
  Target: AGXT; (-) strand; PAM type: YTN; PAM sequence: TTT
tagcgcagcttctccctctg

SEQ ID NO: 14887 - DNA, 20 bp, Artificial Sequence
  Description of Artificial Sequence: Synthetic oligonucleotide
  Target: AGXT; (-) strand; PAM type: YTN; PAM sequence: CTG
agcgttttagcgcagcttct

SEQ ID NO: 14888 - DNA, 20 bp, Artificial Sequence
  Description of Artificial Sequence: Synthetic oligonucleotide
  Target: AGXT; (-) strand; PAM type: YTN; PAM sequence: CTC
aggcctgagcgttttagcgc

SEQ ID NO: 14889 - DNA, 20 bp, Artificial Sequence
  Description of Artificial Sequence: Synthetic oligonucleotide
  Target: AGXT; (-) strand; PAM type: YTN; PAM sequence: CTG
cgtggcagccatgacctcag

SEQ ID NO: 14890 - DNA, 20 bp, Artificial Sequence
  Description of Artificial Sequence: Synthetic oligonucleotide
  Target: AGXT; (-) strand; PAM type: YTN; PAM sequence: CTG
ctgcgtggcagccatgacct

SEQ ID NO: 14891 - DNA, 20 bp, Artificial Sequence
  Description of Artificial Sequence: Synthetic oligonucleotide
  Target: AGXT; (-) strand; PAM type: YTN; PAM sequence: CTG
ggcactgctgcgtggcagcc

SEQ ID NO: 14892 - DNA, 20 bp, Artificial Sequence
  Description of Artificial Sequence: Synthetic oligonucleotide
  Target: AGXT; (-) strand; PAM type: YTN; PAM sequence: TTC
aaatctgggcactgctgcgt

SEQ ID NO: 14893 - DNA, 20 bp, Artificial Sequence
  Description of Artificial Sequence: Synthetic oligonucleotide
  Target: AGXT; (-) strand; PAM type: YTN; PAM sequence: CTG
ggttcaaatctgggcactgc

SEQ ID NO: 14894 - DNA, 20 bp, Artificial Sequence
  Description of Artificial Sequence: Synthetic oligonucleotide
  Target: AGXT; (-) strand; PAM type: YTN; PAM sequence: CTA
ccacgaatccgtacacgata

SEQ ID NO: 14895 - DNA, 20 bp, Artificial Sequence
  Description of Artificial Sequence: Synthetic oligonucleotide
  Target: AGXT; (-) strand; PAM type: YTN; PAM sequence: CTA
cgaccctaccacgaatccgt

SEQ ID NO: 14896 - DNA, 20 bp, Artificial Sequence
  Description of Artificial Sequence: Synthetic oligonucleotide
  Target: AGXT; (-) strand; PAM type: YTN; PAM sequence: CTG
gtaggctacgaccctaccac

SEQ ID NO: 14897 - DNA, 20 bp, Artificial Sequence
  Description of Artificial Sequence: Synthetic oligonucleotide
  Target: AGXT; (-) strand; PAM type: YTN; PAM sequence: CTA
atgggctggtaggctacgac

SEQ ID NO: 14898 - DNA, 20 bp, Artificial Sequence
  Description of Artificial Sequence: Synthetic oligonucleotide
  Target: AGXT; (-) strand; PAM type: YTN; PAM sequence: CTA
gctaatgggctggtaggcta

SEQ ID NO: 14899 - DNA, 20 bp, Artificial Sequence
  Description of Artificial Sequence: Synthetic oligonucleotide
  Target: AGXT; (-) strand; PAM type: YTN; PAM sequence: CTG
cctagctaatgggctggtag

SEQ ID NO: 14900 - DNA, 20 bp, Artificial Sequence
  Description of Artificial Sequence: Synthetic oligonucleotide
  Target: AGXT; (-) strand; PAM type: YTN; PAM sequence: CTC
agggcaggccagtccagcgg

SEQ ID NO: 14901 - DNA, 20 bp, Artificial Sequence
  Description of Artificial Sequence: Synthetic oligonucleotide
  Target: AGXT; (-) strand; PAM type: YTN; PAM sequence: CTC
gggacgggtgagtcccacct

SEQ ID NO: 14902 - DNA, 20 bp, Artificial Sequence
  Description of Artificial Sequence: Synthetic oligonucleotide
  Target: AGXT; (-) strand; PAM type: YTN; PAM sequence: TTG
ctcgggacgggtgagtccca

SEQ ID NO: 14903 - DNA, 20 bp, Artificial Sequence
  Description of Artificial Sequence: Synthetic oligonucleotide
  Target: AGXT; (-) strand; PAM type: YTN; PAM sequence: TTT
gctcgggacgggtgagtccc

SEQ ID NO: 14904 - DNA, 20 bp, Artificial Sequence
  Description of Artificial Sequence: Synthetic oligonucleotide
  Target: AGXT; (-) strand; PAM type: YTN; PAM sequence: CTG
tagatgggtggtttgctcgg

SEQ ID NO: 14905 - DNA, 20 bp, Artificial Sequence
  Description of Artificial Sequence: Synthetic oligonucleotide
  Target: AGXT; (-) strand; PAM type: YTN; PAM sequence: CTG
ggagcccgagtacaggatgt

SEQ ID NO: 14906 - DNA, 20 bp, Artificial Sequence
  Description of Artificial Sequence: Synthetic oligonucleotide
  Target: AGXT; (-) strand; PAM type: YTN; PAM sequence: TTC
tgggagcccgagtacaggat

SEQ ID NO: 14907 - DNA, 20 bp, Artificial Sequence
  Description of Artificial Sequence: Synthetic oligonucleotide
  Target: AGXT; (-) strand; PAM type: YTN; PAM sequence: CTT
ctgggagcccgagtacagga

SEQ ID NO: 14908 - DNA, 20 bp, Artificial Sequence
  Description of Artificial Sequence: Synthetic oligonucleotide
  Target: AGXT; (-) strand; PAM type: YTN; PAM sequence: TTC
agggccttctgggagcccga

SEQ ID NO: 14909 - DNA, 20 bp, Artificial Sequence
  Description of Artificial Sequence: Synthetic oligonucleotide
  Target: AGXT; (-) strand; PAM type: YTN; PAM sequence: CTG
gaggggcgttcagggccttc

SEQ ID NO: 14910 - DNA, 20 bp, Artificial Sequence
  Description of Artificial Sequence: Synthetic oligonucleotide
  Target: AGXT; (-) strand; PAM type: YTN; PAM sequence: CTG
aaggagatgagcgaggtccc

SEQ ID NO: 14911 - DNA, 20 bp, Artificial Sequence
  Description of Artificial Sequence: Synthetic oligonucleotide
  Target: AGXT; (-) strand; PAM type: YTN; PAM sequence: TTG
tcactgaaggagatgagcga

SEQ ID NO: 14912 - DNA, 20 bp, Artificial Sequence
  Description of Artificial Sequence: Synthetic oligonucleotide
  Target: AGXT; (-) strand; PAM type: YTN; PAM sequence: CTT
gtcactgaaggagatgagcg

SEQ ID NO: 14913 - DNA, 20 bp, Artificial Sequence
  Description of Artificial Sequence: Synthetic oligonucleotide
  Target: AGXT; (-) strand; PAM type: YTN; PAM sequence: TTG
gccttgtcactgaaggagat

SEQ ID NO: 14914 - DNA, 20 bp, Artificial Sequence
  Description of Artificial Sequence: Synthetic oligonucleotide
  Target: AGXT; (-) strand; PAM type: YTN; PAM sequence: CTT
ggccttgtcactgaaggaga

SEQ ID NO: 14915 - DNA, 20 bp, Artificial Sequence
  Description of Artificial Sequence: Synthetic oligonucleotide
  Target: AGXT; (-) strand; PAM type: YTN; PAM sequence: CTC
acttggccttgtcactgaag

SEQ ID NO: 14916 - DNA, 20 bp, Artificial Sequence
  Description of Artificial Sequence: Synthetic oligonucleotide
  Target: AGXT; (-) strand; PAM type: YTN; PAM sequence: CTG
tgggtcactcacttggcctt

SEQ ID NO: 14917 - DNA, 20 bp, Artificial Sequence
  Description of Artificial Sequence: Synthetic oligonucleotide
  Target: AGXT; (-) strand; PAM type: YTN; PAM sequence: CTG
cacagaggtgagggtctgtg

SEQ ID NO: 14918 - DNA, 20 bp, Artificial Sequence
  Description of Artificial Sequence: Synthetic oligonucleotide
  Target: AGXT; (-) strand; PAM type: YTN; PAM sequence: CTG
caagcccagccctgcacaga

SEQ ID NO: 14919 - DNA, 20 bp, Artificial Sequence
  Description of Artificial Sequence: Synthetic oligonucleotide
  Target: AGXT; (-) strand; PAM type: YTN; PAM sequence: CTC
cctgcaagcccagccctgca

SEQ ID NO: 14920 - DNA, 20 bp, Artificial Sequence
  Description of Artificial Sequence: Synthetic oligonucleotide
  Target: AGXT; (-) strand; PAM type: YTN; PAM sequence: CTG
agctccctgcaagcccagcc

SEQ ID NO: 14921 - DNA, 20 bp, Artificial Sequence
  Description of Artificial Sequence: Synthetic oligonucleotide
  Target: AGXT; (-) strand; PAM type: YTN; PAM sequence: CTC
gggccacctgagctccctgc

SEQ ID NO: 14922 - DNA, 20 bp, Artificial Sequence
  Description of Artificial Sequence: Synthetic oligonucleotide
  Target: AGXT; (-) strand; PAM type: YTN; PAM sequence: CTC
ccgcctcgggccacctgagc

SEQ ID NO: 14923 - DNA, 20 bp, Artificial Sequence
  Description of Artificial Sequence: Synthetic oligonucleotide
  Target: AGXT; (-) strand; PAM type: YTN; PAM sequence: CTC
ccgcccctcccgcctcgggc

SEQ ID NO: 14924 - DNA, 20 bp, Artificial Sequence
  Description of Artificial Sequence: Synthetic oligonucleotide
  Target: AGXT; (-) strand; PAM type: YTN; PAM sequence: CTG
gctcccgcccctcccgcctc

SEQ ID NO: 14925 - DNA, 20 bp, Artificial Sequence
  Description of Artificial Sequence: Synthetic oligonucleotide
  Target: AGXT; (-) strand; PAM type: YTN; PAM sequence: CTG
cctggctcccgcccctcccg

SEQ ID NO: 14926 - DNA, 20 bp, Artificial Sequence
  Description of Artificial Sequence: Synthetic oligonucleotide
  Target: AGXT; (-) strand; PAM type: YTN; PAM sequence: TTC
ctgcctggctcccgcccctc

SEQ ID NO: 14927 - DNA, 20 bp, Artificial Sequence
  Description of Artificial Sequence: Synthetic oligonucleotide
  Target: AGXT; (-) strand; PAM type: YTN; PAM sequence: CTT
cctgcctggctcccgcccct

SEQ ID NO: 14928 - DNA, 20 bp, Artificial Sequence
  Description of Artificial Sequence: Synthetic oligonucleotide
  Target: AGXT; (-) strand; PAM type: YTN; PAM sequence: CTG
gaggagcatggggagccctt

SEQ ID NO: 14929 - DNA, 20 bp, Artificial Sequence
  Description of Artificial Sequence: Synthetic oligonucleotide
  Target: AGXT; (-) strand; PAM type: YTN; PAM sequence: CTC
ccagagggtgggcgggagag

SEQ ID NO: 14930 - DNA, 20 bp, Artificial Sequence
  Description of Artificial Sequence: Synthetic oligonucleotide
  Target: AGXT; (-) strand; PAM type: YTN; PAM sequence: TTG
gcctcccagagggtgggcgg

SEQ ID NO: 14931 - DNA, 20 bp, Artificial Sequence
  Description of Artificial Sequence: Synthetic oligonucleotide
  Target: AGXT; (-) strand; PAM type: YTN; PAM sequence: TTT
ggcctcccagagggtgggcg

SEQ ID NO: 14932 - DNA, 20 bp, Artificial Sequence
  Description of Artificial Sequence: Synthetic oligonucleotide
  Target: AGXT; (-) strand; PAM type: YTN; PAM sequence: CTT
tggcctcccagagggtgggc

SEQ ID NO: 14933 - DNA, 20 bp, Artificial Sequence
  Description of Artificial Sequence: Synthetic oligonucleotide
  Target: AGXT; (-) strand; PAM type: YTN; PAM sequence: CTG
tgaacgcagtgcctttggcc

SEQ ID NO: 14934 - DNA, 20 bp, Artificial Sequence
  Description of Artificial Sequence: Synthetic oligonucleotide
  Target: AGXT; (-) strand; PAM type: YTN; PAM sequence: CTC
cctgtgaacgcagtgccttt

SEQ ID NO: 14935 - DNA, 20 bp, Artificial Sequence
  Description of Artificial Sequence: Synthetic oligonucleotide
  Target: AGXT; (-) strand; PAM type: YTN; PAM sequence: CTC
cccactccctgtgaacgcag

SEQ ID NO: 14936 - DNA, 20 bp, Artificial Sequence
  Description of Artificial Sequence: Synthetic oligonucleotide
  Target: AGXT; (-) strand; PAM type: YTN; PAM sequence: CTC
gcccggcctccccactccct

SEQ ID NO: 14937 - DNA, 20 bp, Artificial Sequence
  Description of Artificial Sequence: Synthetic oligonucleotide
  Target: AGXT; (-) strand; PAM type: YTN; PAM sequence: CTC
ccctcgcccggcctccccac

SEQ ID NO: 14938 - DNA, 20 bp, Artificial Sequence
  Description of Artificial Sequence: Synthetic oligonucleotide
  Target: AGXT; (-) strand; PAM type: YTN; PAM sequence: CTG
cagccctcccctcgcccggc

SEQ ID NO: 14939 - DNA, 20 bp, Artificial Sequence
  Description of Artificial Sequence: Synthetic oligonucleotide
  Target: AGXT; (-) strand; PAM type: YTN; PAM sequence: CTG
cacacgcctgcagccctccc

SEQ ID NO: 14940 - DNA, 20 bp, Artificial Sequence
  Description of Artificial Sequence: Synthetic oligonucleotide
  Target: AGXT; (-) strand; PAM type: YTN; PAM sequence: CTG
caccctgcacacgcctgcag

SEQ ID NO: 14941 - DNA, 20 bp, Artificial Sequence
  Description of Artificial Sequence: Synthetic oligonucleotide
  Target: AGXT; (-) strand; PAM type: YTN; PAM sequence: CTC
tgcaccctgcacacgcctgc

SEQ ID NO: 14942 - DNA, 20 bp, Artificial Sequence
  Description of Artificial Sequence: Synthetic oligonucleotide
  Target: AGXT; (-) strand; PAM type: YTN; PAM sequence: TTC
cagagcagtggactctgcac

SEQ ID NO: 14943 - DNA, 20 bp, Artificial Sequence
  Description of Artificial Sequence: Synthetic oligonucleotide
  Target: AGXT; (-) strand; PAM type: YTN; PAM sequence: CTT
ccagagcagtggactctgca

SEQ ID NO: 14944 - DNA, 20 bp, Artificial Sequence
  Description of Artificial Sequence: Synthetic oligonucleotide
  Target: AGXT; (-) strand; PAM type: YTN; PAM sequence: CTG
ggaacttccagagcagtgga

SEQ ID NO: 14945 - DNA, 20 bp, Artificial Sequence
  Description of Artificial Sequence: Synthetic oligonucleotide
  Target: AGXT; (-) strand; PAM type: YTN; PAM sequence: CTG
tgaagctgggaacttccaga

SEQ ID NO: 14946 - DNA, 20 bp, Artificial Sequence
  Description of Artificial Sequence: Synthetic oligonucleotide
  Target: AGXT; (-) strand; PAM type: YTN; PAM sequence: TTG
ctgtgaagctgggaacttcc

SEQ ID NO: 14947 - DNA, 20 bp, Artificial Sequence
  Description of Artificial Sequence: Synthetic oligonucleotide
  Target: AGXT; (-) strand; PAM type: YTN; PAM sequence: CTT
gctgtgaagctgggaacttc

SEQ ID NO: 14948 - DNA, 20 bp, Artificial Sequence
  Description of Artificial Sequence: Synthetic oligonucleotide
  Target: AGXT; (-) strand; PAM type: YTN; PAM sequence: CTC
cttgctgtgaagctgggaac

SEQ ID NO: 14949 - DNA, 20 bp, Artificial Sequence
  Description of Artificial Sequence: Synthetic oligonucleotide
  Target: AGXT; (-) strand; PAM type: YTN; PAM sequence: CTG
gtcactccttgctgtgaagc

SEQ ID NO: 14950 - DNA, 20 bp, Artificial Sequence
  Description of Artificial Sequence: Synthetic oligonucleotide
  Target: AGXT; (-) strand; PAM type: YTN; PAM sequence: TTC
ctggtcactccttgctgtga

SEQ ID NO: 14951 - DNA, 20 bp, Artificial Sequence
  Description of Artificial Sequence: Synthetic oligonucleotide
  Target: AGXT; (-) strand; PAM type: YTN; PAM sequence: TTT
cctggtcactccttgctgtg

SEQ ID NO: 14952 - DNA, 20 bp, Artificial Sequence
  Description of Artificial Sequence: Synthetic oligonucleotide
  Target: AGXT; (-) strand; PAM type: YTN; PAM sequence: CTT
tcctggtcactccttgctgt

SEQ ID NO: 14953 - DNA, 20 bp, Artificial Sequence
  Description of Artificial Sequence: Synthetic oligonucleotide
  Target: AGXT; (-) strand; PAM type: YTN; PAM sequence: CTC
agtcctttcctggtcactcc

SEQ ID NO: 14954 - DNA, 20 bp, Artificial Sequence
  Description of Artificial Sequence: Synthetic oligonucleotide
  Target: AGXT; (-) strand; PAM type: YTN; PAM sequence: CTC
aggccctcagtcctttcctg

SEQ ID NO: 14955 - DNA, 20 bp, Artificial Sequence
  Description of Artificial Sequence: Synthetic oligonucleotide
  Target: AGXT; (-) strand; PAM type: YTN; PAM sequence: CTG
ggcctcaggccctcagtcct

SEQ ID NO: 14956 - DNA, 20 bp, Artificial Sequence
  Description of Artificial Sequence: Synthetic oligonucleotide
  Target: AGXT; (-) strand; PAM type: YTN; PAM sequence: CTG
agccagggcagaggccggtc

SEQ ID NO: 14957 - DNA, 20 bp, Artificial Sequence
  Description of Artificial Sequence: Synthetic oligonucleotide
  Target: AGXT; (-) strand; PAM type: YTN; PAM sequence: CTG
gaagctgagccagggcagag

SEQ ID NO: 14958 - DNA, 20 bp, Artificial Sequence
  Description of Artificial Sequence: Synthetic oligonucleotide
  Target: AGXT; (-) strand; PAM type: YTN; PAM sequence: TTG
gggcagcccctggaagctga

SEQ ID NO: 14959 - DNA, 20 bp, Artificial Sequence
  Description of Artificial Sequence: Synthetic oligonucleotide
  Target: AGXT; (-) strand; PAM type: YTN; PAM sequence: CTT
ggggcagcccctggaagctg

SEQ ID NO: 14960 - DNA, 20 bp, Artificial Sequence
  Description of Artificial Sequence: Synthetic oligonucleotide
  Target: AGXT; (-) strand; PAM type: YTN; PAM sequence: TTG
tcccttggggcagcccctgg

SEQ ID NO: 14961 - DNA, 20 bp, Artificial Sequence
  Description of Artificial Sequence: Synthetic oligonucleotide
  Target: AGXT; (-) strand; PAM type: YTN; PAM sequence: CTG
tgtgtggcccacgttgtccc

SEQ ID NO: 14962 - DNA, 20 bp, Artificial Sequence
  Description of Artificial Sequence: Synthetic oligonucleotide
  Target: AGXT; (-) strand; PAM type: YTN; PAM sequence: CTG
cagggggcactgtgtgtggc

SEQ ID NO: 14963 - DNA, 20 bp, Artificial Sequence
  Description of Artificial Sequence: Synthetic oligonucleotide
  Target: AGXT; (-) strand; PAM type: YTN; PAM sequence: TTG
ggactgcagggggcactgtg

SEQ ID NO: 14964 - DNA, 20 bp, Artificial Sequence
  Description of Artificial Sequence: Synthetic oligonucleotide
  Target: AGXT; (-) strand; PAM type: YTN; PAM sequence: CTG
gacaccaggagcgggaggtg

SEQ ID NO: 14965 - DNA, 20 bp, Artificial Sequence
  Description of Artificial Sequence: Synthetic oligonucleotide
  Target: AGXT; (-) strand; PAM type: YTN; PAM sequence: CTC
agaatctggacaccaggagc

SEQ ID NO: 14966 - DNA, 20 bp, Artificial Sequence
  Description of Artificial Sequence: Synthetic oligonucleotide
  Target: AGXT; (-) strand; PAM type: YTN; PAM sequence: CTG
gctcagaatctggacaccag

SEQ ID NO: 14967 - DNA, 20 bp, Artificial Sequence
  Description of Artificial Sequence: Synthetic oligonucleotide
  Target: AGXT; (-) strand; PAM type: YTN; PAM sequence: CTG
cccggcctggctcagaatct

SEQ ID NO: 14968 - DNA, 20 bp, Artificial Sequence
  Description of Artificial Sequence: Synthetic oligonucleotide
  Target: AGXT; (-) strand; PAM type: YTN; PAM sequence: CTA
ccccctgcccggcctggctc

SEQ ID NO: 14969 - DNA, 20 bp, Artificial Sequence
  Description of Artificial Sequence: Synthetic oligonucleotide
  Target: AGXT; (-) strand; PAM type: YTN; PAM sequence: TTC
ccctaccccctgcccggcct

SEQ ID NO: 14970 - DNA, 20 bp, Artificial Sequence
  Description of Artificial Sequence: Synthetic oligonucleotide
  Target: AGXT; (-) strand; PAM type: YTN; PAM sequence: CTT
cccctaccccctgcccggcc

SEQ ID NO: 14971 - DNA, 20 bp, Artificial Sequence
  Description of Artificial Sequence: Synthetic oligonucleotide
  Target: AGXT; (-) strand; PAM type: YTN; PAM sequence: CTG
gcccccttcccctaccccct

SEQ ID NO: 14972 - DNA, 20 bp, Artificial Sequence
  Description of Artificial Sequence: Synthetic oligonucleotide
  Target: AGXT; (-) strand; PAM type: YTN; PAM sequence: CTG
tgaggtctggcccccttccc

SEQ ID NO: 14973 - DNA, 20 bp, Artificial Sequence
  Description of Artificial Sequence: Synthetic oligonucleotide
  Target: AGXT; (-) strand; PAM type: YTN; PAM sequence: CTG
gatgggaaccgcctgtgagg

SEQ ID NO: 14974 - DNA, 20 bp, Artificial Sequence
  Description of Artificial Sequence: Synthetic oligonucleotide
  Target: AGXT; (-) strand; PAM type: YTN; PAM sequence: CTG
cagctggatgggaaccgcct

SEQ ID NO: 14975 - DNA, 20 bp, Artificial Sequence
  Description of Artificial Sequence: Synthetic oligonucleotide
  Target: AGXT; (-) strand; PAM type: YTN; PAM sequence: TTG
ccaggctgcagctggatggg

SEQ ID NO: 14976 - DNA, 20 bp, Artificial Sequence
  Description of Artificial Sequence: Synthetic oligonucleotide
  Target: AGXT; (-) strand; PAM type: YTN; PAM sequence: CTC
cagttgccaggctgcagctg

SEQ ID NO: 14977 - DNA, 20 bp, Artificial Sequence
  Description of Artificial Sequence: Synthetic oligonucleotide
  Target: AGXT; (-) strand; PAM type: YTN; PAM sequence: CTG
gggaacggcacctccagttg

SEQ ID NO: 14978 - DNA, 20 bp, Artificial Sequence
  Description of Artificial Sequence: Synthetic oligonucleotide
  Target: AGXT; (-) strand; PAM type: YTN; PAM sequence: TTC
tggggaacggcacctccagt

SEQ ID NO: 14979 - DNA, 20 bp, Artificial Sequence
  Description of Artificial Sequence: Synthetic oligonucleotide
  Target: AGXT; (-) strand; PAM type: YTN; PAM sequence: CTG
ttctggggaacggcacctcc

SEQ ID NO: 14980 - DNA, 20 bp, Artificial Sequence
  Description of Artificial Sequence: Synthetic oligonucleotide
  Target: AGXT; (-) strand; PAM type: YTN; PAM sequence: CTC
tgttctggggaacggcacct

SEQ ID NO: 14981 - DNA, 20 bp, Artificial Sequence
  Description of Artificial Sequence: Synthetic oligonucleotide
  Target: AGXT; (-) strand; PAM type: YTN; PAM sequence: CTC
tctgttctggggaacggcac

SEQ ID NO: 14982 - DNA, 20 bp, Artificial Sequence
  Description of Artificial Sequence: Synthetic oligonucleotide
  Target: AGXT; (-) strand; PAM type: YTN; PAM sequence: CTC
cccgaagtcctctctgttct

SEQ ID NO: 14983 - DNA, 20 bp, Artificial Sequence
  Description of Artificial Sequence: Synthetic oligonucleotide
  Target: AGXT; (-) strand; PAM type: YTN; PAM sequence: TTC
tccccgaagtcctctctgtt

SEQ ID NO: 14984 - DNA, 20 bp, Artificial Sequence
  Description of Artificial Sequence: Synthetic oligonucleotide
  Target: AGXT; (-) strand; PAM type: YTN; PAM sequence: CTT
ctccccgaagtcctctctgt

SEQ ID NO: 14985 - DNA, 20 bp, Artificial Sequence
  Description of Artificial Sequence: Synthetic oligonucleotide
  Target: AGXT; (-) strand; PAM type: YTN; PAM sequence: CTG
acttctccccgaagtcctct

SEQ ID NO: 14986 - DNA, 20 bp, Artificial Sequence
  Description of Artificial Sequence: Synthetic oligonucleotide
  Target: AGXT; (-) strand; PAM type: YTN; PAM sequence: TTC
ctgacttctccccgaagtcc

SEQ ID NO: 14987 - DNA, 20 bp, Artificial Sequence
  Description of Artificial Sequence: Synthetic oligonucleotide
  Target: AGXT; (-) strand; PAM type: YTN; PAM sequence: CTC
ccacgtccaacaccgaattc

SEQ ID NO: 14988 - DNA, 20 bp, Artificial Sequence
  Description of Artificial Sequence: Synthetic oligonucleotide
  Target: AGXT; (-) strand; PAM type: YTN; PAM sequence: CTC
agacctcccacgtccaacac

SEQ ID NO: 14989 - DNA, 20 bp, Artificial Sequence
  Description of Artificial Sequence: Synthetic oligonucleotide
  Target: AGXT; (-) strand; PAM type: YTN; PAM sequence: CTG
gcatctcagacctcccacgt

SEQ ID NO: 14990 - DNA, 20 bp, Artificial Sequence
  Description of Artificial Sequence: Synthetic oligonucleotide
  Target: AGXT; (-) strand; PAM type: YTN; PAM sequence: CTC
ccgtgtggtccagctggcat

SEQ ID NO: 14991 - DNA, 20 bp, Artificial Sequence
  Description of Artificial Sequence: Synthetic oligonucleotide
  Target: AGXT; (-) strand; PAM type: YTN; PAM sequence: TTC
accctcccgtgtggtccagc

SEQ ID NO: 14992 - DNA, 20 bp, Artificial Sequence
  Description of Artificial Sequence: Synthetic oligonucleotide
  Target: AGXT; (-) strand; PAM type: YTN; PAM sequence: CTT
caccctcccgtgtggtccag

SEQ ID NO: 14993 - DNA, 20 bp, Artificial Sequence
  Description of Artificial Sequence: Synthetic oligonucleotide
  Target: AGXT; (-) strand; PAM type: YTN; PAM sequence: TTC
cttcaccctcccgtgtggtc

SEQ ID NO: 14994 - DNA, 20 bp, Artificial Sequence
  Description of Artificial Sequence: Synthetic oligonucleotide
  Target: AGXT; (-) strand; PAM type: YTN; PAM sequence: CTT
ccttcaccctcccgtgtggt

SEQ ID NO: 14995 - DNA, 20 bp, Artificial Sequence
  Description of Artificial Sequence: Synthetic oligonucleotide
  Target: AGXT; (-) strand; PAM type: YTN; PAM sequence: CTC
acacccagccgcttccttca

SEQ ID NO: 14996 - DNA, 20 bp, Artificial Sequence
  Description of Artificial Sequence: Synthetic oligonucleotide
  Target: AGXT; (-) strand; PAM type: YTN; PAM sequence: CTG
actcacacccagccgcttcc

SEQ ID NO: 14997 - DNA, 20 bp, Artificial Sequence
  Description of Artificial Sequence: Synthetic oligonucleotide
  Target: AGXT; (-) strand; PAM type: YTN; PAM sequence: CTC
ctgactcacacccagccgct

SEQ ID NO: 14998 - DNA, 20 bp, Artificial Sequence
  Description of Artificial Sequence: Synthetic oligonucleotide
  Target: AGXT; (-) strand; PAM type: YTN; PAM sequence: CTC
cccaggctcctgactcacac

SEQ ID NO: 14999 - DNA, 20 bp, Artificial Sequence
  Description of Artificial Sequence: Synthetic oligonucleotide
  Target: AGXT; (-) strand; PAM type: YTN; PAM sequence: CTC
tccccaggctcctgactcac

SEQ ID NO: 15000 - DNA, 20 bp, Artificial Sequence
  Description of Artificial Sequence: Synthetic oligonucleotide
  Target: AGXT; (-) strand; PAM type: YTN; PAM sequence: CTC
cagatggaggggccagcccc

SEQ ID NO: 15001 - DNA, 20 bp, Artificial Sequence
  Description of Artificial Sequence: Synthetic oligonucleotide
  Target: AGXT; (-) strand; PAM type: YTN; PAM sequence: CTA
caactccagatggaggggcc

SEQ ID NO: 15002 - DNA, 20 bp, Artificial Sequence
  Description of Artificial Sequence: Synthetic oligonucleotide
  Target: AGXT; (-) strand; PAM type: YTN; PAM sequence: CTC
tacaactccagatggagggg

SEQ ID NO: 15003 - DNA, 20 bp, Artificial Sequence
  Description of Artificial Sequence: Synthetic oligonucleotide
  Target: AGXT; (-) strand; PAM type: YTN; PAM sequence: TTA
aatgtgtccgtctctacaac

SEQ ID NO: 15004 - DNA, 20 bp, Artificial Sequence
  Description of Artificial Sequence: Synthetic oligonucleotide
  Target: AGXT; (-) strand; PAM type: YTN; PAM sequence: TTT
aaatgtgtccgtctctacaa

SEQ ID NO: 15005 - DNA, 20 bp, Artificial Sequence
  Description of Artificial Sequence: Synthetic oligonucleotide
  Target: AGXT; (-) strand; PAM type: YTN; PAM sequence: CTT
taaatgtgtccgtctctaca

SEQ ID NO: 15006 - DNA, 20 bp, Artificial Sequence
  Description of Artificial Sequence: Synthetic oligonucleotide
  Target: AGXT; (-) strand; PAM type: YTN; PAM sequence: TTG
aaactttaaatgtgtccgtc

SEQ ID NO: 15007 - DNA, 20 bp, Artificial Sequence
  Description of Artificial Sequence: Synthetic oligonucleotide
  Target: AGXT; (-) strand; PAM type: YTN; PAM sequence: CTT
gaaactttaaatgtgtccgt

SEQ ID NO: 15008 - DNA, 20 bp, Artificial Sequence
  Description of Artificial Sequence: Synthetic oligonucleotide
  Target: AGXT; (-) strand; PAM type: YTN; PAM sequence: CTG
gccaggcttgaaactttaaa

SEQ ID NO: 15009 - DNA, 20 bp, Artificial Sequence
  Description of Artificial Sequence: Synthetic oligonucleotide
  Target: AGXT; (-) strand; PAM type: YTN; PAM sequence: TTC
gggccccaggggacactggc

SEQ ID NO: 15010 - DNA, 20 bp, Artificial Sequence
  Description of Artificial Sequence: Synthetic oligonucleotide
  Target: AGXT; (-) strand; PAM type: YTN; PAM sequence: TTT
cgggccccaggggacactgg

SEQ ID NO: 15011 - DNA, 20 bp, Artificial Sequence
  Description of Artificial Sequence: Synthetic oligonucleotide
  Target: AGXT; (-) strand; PAM type: YTN; PAM sequence: CTT
tcgggccccaggggacactg

SEQ ID NO: 15012 - DNA, 20 bp, Artificial Sequence
  Description of Artificial Sequence: Synthetic oligonucleotide
  Target: AGXT; (-) strand; PAM type: YTN; PAM sequence: CTG
ctttcgggccccaggggaca

SEQ ID NO: 15013 - DNA, 20 bp, Artificial Sequence
  Description of Artificial Sequence: Synthetic oligonucleotide
  Target: AGXT; (-) strand; PAM type: YTN; PAM sequence: CTC
acatcacccaaaggtgactg

SEQ ID NO: 15014 - DNA, 20 bp, Artificial Sequence
  Description of Artificial Sequence: Synthetic oligonucleotide
  Target: AGXT; (-) strand; PAM type: YTN; PAM sequence: TTC
tcacatcacccaaaggtgac

SEQ ID NO: 15015 - DNA, 20 bp, Artificial Sequence
  Description of Artificial Sequence: Synthetic oligonucleotide
  Target: AGXT; (-) strand; PAM type: YTN; PAM sequence: TTT
ctcacatcacccaaaggtga

SEQ ID NO: 15016 - DNA, 20 bp, Artificial Sequence
  Description of Artificial Sequence: Synthetic oligonucleotide
  Target: AGXT; (-) strand; PAM type: YTN; PAM sequence: TTC
atttctcacatcacccaaag

SEQ ID NO: 15017 - DNA, 20 bp, Artificial Sequence
  Description of Artificial Sequence: Synthetic oligonucleotide
  Target: AGXT; (-) strand; PAM type: YTN; PAM sequence: CTT
catttctcacatcacccaaa

SEQ ID NO: 15018 - DNA, 20 bp, Artificial Sequence
  Description of Artificial Sequence: Synthetic oligonucleotide
  Target: AGXT; (-) strand; PAM type: YTN; PAM sequence: CTA
cagggtcagccttcatttct

SEQ ID NO: 15019 - DNA, 20 bp, Artificial Sequence
  Description of Artificial Sequence: Synthetic oligonucleotide
  Target: AGXT; (-) strand; PAM type: YTN; PAM sequence: CTC
ctacagggtcagccttcatt

SEQ ID NO: 15020 - DNA, 20 bp, Artificial Sequence
  Description of Artificial Sequence: Synthetic oligonucleotide
  Target: AGXT; (-) strand; PAM type: YTN; PAM sequence: CTC
ccccagcccctcctacaggg

SEQ ID NO: 15021 - DNA, 20 bp, Artificial Sequence
  Description of Artificial Sequence: Synthetic oligonucleotide
  Target: AGXT; (-) strand; PAM type: YTN; PAM sequence: CTC
tcccccagcccctcctacag

SEQ ID NO: 15022 - DNA, 20 bp, Artificial Sequence
  Description of Artificial Sequence: Synthetic oligonucleotide
  Target: AGXT; (-) strand; PAM type: YTN; PAM sequence: TTC
tctcccccagcccctcctac

SEQ ID NO: 15023 - DNA, 20 bp, Artificial Sequence
  Description of Artificial Sequence: Synthetic oligonucleotide
  Target: AGXT; (-) strand; PAM type: YTN; PAM sequence: TTT
ctctcccccagcccctccta

SEQ ID NO: 15024 - DNA, 20 bp, Artificial Sequence
  Description of Artificial Sequence: Synthetic oligonucleotide
  Target: AGXT; (-) strand; PAM type: YTN; PAM sequence: CTT
tctctcccccagcccctcct

SEQ ID NO: 15025 - DNA, 20 bp, Artificial Sequence
  Description of Artificial Sequence: Synthetic oligonucleotide
  Target: AGXT; (-) strand; PAM type: YTN; PAM sequence: CTG
tgtgcccctttctctccccc

SEQ ID NO: 15026 - DNA, 20 bp, Artificial Sequence
  Description of Artificial Sequence: Synthetic oligonucleotide
  Target: AGXT; (-) strand; PAM type: YTN; PAM sequence: CTC
tgtgtgcccctttctctccc

SEQ ID NO: 15027 - DNA, 20 bp, Artificial Sequence
  Description of Artificial Sequence: Synthetic oligonucleotide
  Target: AGXT; (-) strand; PAM type: YTN; PAM sequence: CTC
cactctgtgtgcccctttct

SEQ ID NO: 15028 - DNA, 20 bp, Artificial Sequence
  Description of Artificial Sequence: Synthetic oligonucleotide
  Target: AGXT; (-) strand; PAM type: YTN; PAM sequence: CTC
cctccactctgtgtgcccct

SEQ ID NO: 15029 - DNA, 20 bp, Artificial Sequence
  Description of Artificial Sequence: Synthetic oligonucleotide
  Target: AGXT; (-) strand; PAM type: YTN; PAM sequence: CTG
ccatgggggcaccaaggcca

SEQ ID NO: 15030 - DNA, 20 bp, Artificial Sequence
  Description of Artificial Sequence: Synthetic oligonucleotide
  Target: AGXT; (-) strand; PAM type: YTN; PAM sequence: CTG
tgtgaccctgccatgggggc

SEQ ID NO: 15031 - DNA, 20 bp, Artificial Sequence
  Description of Artificial Sequence: Synthetic oligonucleotide
  Target: AGXT; (-) strand; PAM type: YTN; PAM sequence: TTG
ggcccagctgtgtgaccctg

SEQ ID NO: 15032 - DNA, 20 bp, Artificial Sequence
  Description of Artificial Sequence: Synthetic oligonucleotide
  Target: AGXT; (-) strand; PAM type: YTN; PAM sequence: CTT
gggcccagctgtgtgaccct

SEQ ID NO: 15033 - DNA, 20 bp, Artificial Sequence
  Description of Artificial Sequence: Synthetic oligonucleotide
  Target: AGXT; (-) strand; PAM type: YTN; PAM sequence: CTG
gcccttgggcccagctgtgt

SEQ ID NO: 15034 - DNA, 20 bp, Artificial Sequence
  Description of Artificial Sequence: Synthetic oligonucleotide
  Target: AGXT; (-) strand; PAM type: YTN; PAM sequence: CTG
tccagtcccgctggcccttg

SEQ ID NO: 15035 - DNA, 20 bp, Artificial Sequence
  Description of Artificial Sequence: Synthetic oligonucleotide
  Target: AGXT; (-) strand; PAM type: YTN; PAM sequence: CTC
agctgtccagtcccgctggc

SEQ ID NO: 15036 - DNA, 20 bp, Artificial Sequence
  Description of Artificial Sequence: Synthetic oligonucleotide
  Target: AGXT; (-) strand; PAM type: YTN; PAM sequence: CTC
aggggccagagtgggaccgg

SEQ ID NO: 15037 - DNA, 20 bp, Artificial Sequence
  Description of Artificial Sequence: Synthetic oligonucleotide
  Target: AGXT; (-) strand; PAM type: YTN; PAM sequence: TTG
tgctcaggggccagagtggg

SEQ ID NO: 15038 - DNA, 20 bp, Artificial Sequence
  Description of Artificial Sequence: Synthetic oligonucleotide
  Target: AGXT; (-) strand; PAM type: YTN; PAM sequence: TTT
gtgctcaggggccagagtgg

SEQ ID NO: 15039 - DNA, 20 bp, Artificial Sequence
  Description of Artificial Sequence: Synthetic oligonucleotide
  Target: AGXT; (-) strand; PAM type: YTN; PAM sequence: CTG
catttgtgctcaggggccag

SEQ ID NO: 15040 - DNA, 20 bp, Artificial Sequence
  Description of Artificial Sequence: Synthetic oligonucleotide
  Target: AGXT; (-) strand; PAM type: YTN; PAM sequence: TTC
acgggagtgagacggggtgg

SEQ ID NO: 15041 - DNA, 20 bp, Artificial Sequence
  Description of Artificial Sequence: Synthetic oligonucleotide
  Target: AGXT; (-) strand; PAM type: YTN; PAM sequence: TTT
cacgggagtgagacggggtg

SEQ ID NO: 15042 - DNA, 20 bp, Artificial Sequence
  Description of Artificial Sequence: Synthetic oligonucleotide
  Target: AGXT; (-) strand; PAM type: YTN; PAM sequence: CTG
tttcacgggagtgagacggg

SEQ ID NO: 15043 - DNA, 20 bp, Artificial Sequence
  Description of Artificial Sequence: Synthetic oligonucleotide
  Target: AGXT; (-) strand; PAM type: YTN; PAM sequence: CTG
tcctgtttcacgggagtgag

SEQ ID NO: 15044 - DNA, 20 bp, Artificial Sequence
  Description of Artificial Sequence: Synthetic oligonucleotide
  Target: AGXT; (-) strand; PAM type: YTN; PAM sequence: CTG
gctgtcctgtttcacgggag

SEQ ID NO: 15045 - DNA, 20 bp, Artificial Sequence
  Description of Artificial Sequence: Synthetic oligonucleotide
  Target: AGXT; (-) strand; PAM type: YTN; PAM sequence: CTC
gctggctgtcctgtttcacg

SEQ ID NO: 15046 - DNA, 20 bp, Artificial Sequence
  Description of Artificial Sequence: Synthetic oligonucleotide
  Target: AGXT; (-) strand; PAM type: YTN; PAM sequence: CTG
aaggccagggcagtctcgct

SEQ ID NO: 15047 - DNA, 20 bp, Artificial Sequence
  Description of Artificial Sequence: Synthetic oligonucleotide
  Target: AGXT; (-) strand; PAM type: YTN; PAM sequence: TTG
ggctgaaggccagggcagtc

SEQ ID NO: 15048 - DNA, 20 bp, Artificial Sequence
  Description of Artificial Sequence: Synthetic oligonucleotide
  Target: AGXT; (-) strand; PAM type: YTN; PAM sequence: TTT
gggctgaaggccagggcagt

SEQ ID NO: 15049 - DNA, 20 bp, Artificial Sequence
  Description of Artificial Sequence: Synthetic oligonucleotide
  Target: AGXT; (-) strand; PAM type: YTN; PAM sequence: CTC
agtttgggctgaaggccagg

SEQ ID NO: 15050 - DNA, 20 bp, Artificial Sequence
  Description of Artificial Sequence: Synthetic oligonucleotide
  Target: AGXT; (-) strand; PAM type: YTN; PAM sequence: CTC
tcagtttgggctgaaggcca

SEQ ID NO: 15051 - DNA, 20 bp, Artificial Sequence
  Description of Artificial Sequence: Synthetic oligonucleotide
  Target: AGXT; (-) strand; PAM type: YTN; PAM sequence: CTG
agcaccagcctctcagtttg

SEQ ID NO: 15052 - DNA, 20 bp, Artificial Sequence
  Description of Artificial Sequence: Synthetic oligonucleotide
  Target: AGXT; (-) strand; PAM type: YTN; PAM sequence: CTG
gggagaaagaagcaggctga

SEQ ID NO: 15053 - DNA, 20 bp, Artificial Sequence
  Description of Artificial Sequence: Synthetic oligonucleotide
  Target: AGXT; (-) strand; PAM type: YTN; PAM sequence: TTC
tggggagaaagaagcaggct

SEQ ID NO: 15054 - DNA, 20 bp, Artificial Sequence
  Description of Artificial Sequence: Synthetic oligonucleotide
  Target: AGXT; (-) strand; PAM type: YTN; PAM sequence: TTT
ctggggagaaagaagcaggc

SEQ ID NO: 15055 - DNA, 20 bp, Artificial Sequence
  Description of Artificial Sequence: Synthetic oligonucleotide
  Target: AGXT; (-) strand; PAM type: YTN; PAM sequence: CTT
tctggggagaaagaagcagg

SEQ ID NO: 15056 - DNA, 20 bp, Artificial Sequence
  Description of Artificial Sequence: Synthetic oligonucleotide
  Target: AGXT; (-) strand; PAM type: YTN; PAM sequence: TTC
tttctggggagaaagaagca

SEQ ID NO: 15057 - DNA, 20 bp, Artificial Sequence
  Description of Artificial Sequence: Synthetic oligonucleotide
  Target: AGXT; (-) strand; PAM type: YTN; PAM sequence: CTT
ctttctggggagaaagaagc

SEQ ID NO: 15058 - DNA, 20 bp, Artificial Sequence
  Description of Artificial Sequence: Synthetic oligonucleotide
  Target: AGXT; (-) strand; PAM type: YTN; PAM sequence: TTG
cgggagtacatcttctttct

SEQ ID NO: 15059 - DNA, 20 bp, Artificial Sequence
  Description of Artificial Sequence: Synthetic oligonucleotide
  Target: AGXT; (-) strand; PAM type: YTN; PAM sequence: CTT
gcgggagtacatcttctttc

SEQ ID NO: 15060 - DNA, 20 bp, Artificial Sequence
  Description of Artificial Sequence: Synthetic oligonucleotide
  Target: AGXT; (-) strand; PAM type: YTN; PAM sequence: TTC
gtcttgcgggagtacatctt

SEQ ID NO: 15061 - DNA, 20 bp, Artificial Sequence
  Description of Artificial Sequence: Synthetic oligonucleotide
  Target: AGXT; (-) strand; PAM type: YTN; PAM sequence: CTT
cgtcttgcgggagtacatct

SEQ ID NO: 15062 - DNA, 20 bp, Artificial Sequence
  Description of Artificial Sequence: Synthetic oligonucleotide
  Target: AGXT; (-) strand; PAM type: YTN; PAM sequence: TTG
atgtccaggtagaaggagaa

SEQ ID NO: 15063 - DNA, 20 bp, Artificial Sequence
  Description of Artificial Sequence: Synthetic oligonucleotide
  Target: AGXT; (-) strand; PAM type: YTN; PAM sequence: CTT
gatgtccaggtagaaggaga

SEQ ID NO: 15064 - DNA, 20 bp, Artificial Sequence
  Description of Artificial Sequence: Synthetic oligonucleotide
  Target: AGXT; (-) strand; PAM type: YTN; PAM sequence: TTG
gccagccacttgatgtccag

SEQ ID NO: 15065 - DNA, 20 bp, Artificial Sequence
  Description of Artificial Sequence: Synthetic oligonucleotide
  Target: AGXT; (-) strand; PAM type: YTN; PAM sequence: CTG
gtcgtcacagccccagaagt

SEQ ID NO: 15066 - DNA, 20 bp, Artificial Sequence
  Description of Artificial Sequence: Synthetic oligonucleotide
  Target: AGXT; (-) strand; PAM type: YTN; PAM sequence: CTG
ggctggtcgtcacagcccca

SEQ ID NO: 15067 - DNA, 20 bp, Artificial Sequence
  Description of Artificial Sequence: Synthetic oligonucleotide
  Target: AGXT; (-) strand; PAM type: YTN; PAM sequence: CTC
acatcctgggctggtcgtca

SEQ ID NO: 15068 - DNA, 20 bp, Artificial Sequence
  Description of Artificial Sequence: Synthetic oligonucleotide
  Target: AGXT; (-) strand; PAM type: YTN; PAM sequence: CTG
ccaggcctcacatcctgggc

SEQ ID NO: 15069 - DNA, 20 bp, Artificial Sequence
  Description of Artificial Sequence: Synthetic oligonucleotide
  Target: AGXT; (-) strand; PAM type: YTN; PAM sequence: TTC
ccatccctgccaggcctcac

SEQ ID NO: 15070 - DNA, 20 bp, Artificial Sequence
  Description of Artificial Sequence: Synthetic oligonucleotide
  Target: AGXT; (-) strand; PAM type: YTN; PAM sequence: CTT
cccatccctgccaggcctca

SEQ ID NO: 15071 - DNA, 20 bp, Artificial Sequence
  Description of Artificial Sequence: Synthetic oligonucleotide
  Target: AGXT; (-) strand; PAM type: YTN; PAM sequence: CTC
caccttcccatccctgccag

SEQ ID NO: 15072 - DNA, 20 bp, Artificial Sequence
  Description of Artificial Sequence: Synthetic oligonucleotide
  Target: AGXT; (-) strand; PAM type: YTN; PAM sequence: CTC
agccatgcccagcgccctcc

SEQ ID NO: 15073 - DNA, 20 bp, Artificial Sequence
  Description of Artificial Sequence: Synthetic oligonucleotide
  Target: AGXT; (-) strand; PAM type: YTN; PAM sequence: CTC
tcagccatgcccagcgccct

SEQ ID NO: 15074 - DNA, 20 bp, Artificial Sequence
  Description of Artificial Sequence: Synthetic oligonucleotide
  Target: AGXT; (-) strand; PAM type: YTN; PAM sequence: CTG
agtgcagtgagaggccagcg

SEQ ID NO: 15075 - DNA, 20 bp, Artificial Sequence
  Description of Artificial Sequence: Synthetic oligonucleotide
  Target: AGXT; (-) strand; PAM type: YTN; PAM sequence: TTG
gagaatccctgagtgcagtg

SEQ ID NO: 15076 - DNA, 20 bp, Artificial Sequence
  Description of Artificial Sequence: Synthetic oligonucleotide
  Target: AGXT; (-) strand; PAM type: YTN; PAM sequence: CTT
ggagaatccctgagtgcagt

SEQ ID NO: 15077 - DNA, 20 bp, Artificial Sequence
  Description of Artificial Sequence: Synthetic oligonucleotide
  Target: AGXT; (-) strand; PAM type: YTN; PAM sequence: TTG
aggcatgaaggtggggggct

SEQ ID NO: 15078 - DNA, 20 bp, Artificial Sequence
  Description of Artificial Sequence: Synthetic oligonucleotide
  Target: AGXT; (-) strand; PAM type: YTN; PAM sequence: CTT
gaggcatgaaggtggggggc

SEQ ID NO: 15079 - DNA, 20 bp, Artificial Sequence
  Description of Artificial Sequence: Synthetic oligonucleotide
  Target: AGXT; (-) strand; PAM type: YTN; PAM sequence: TTC
ttgaggcatgaaggtggggg

SEQ ID NO: 15080 - DNA, 20 bp, Artificial Sequence
  Description of Artificial Sequence: Synthetic oligonucleotide
  Target: AGXT; (-) strand; PAM type: YTN; PAM sequence: TTG
gggttcttgaggcatgaagg

SEQ ID NO: 15081 - DNA, 20 bp, Artificial Sequence
  Description of Artificial Sequence: Synthetic oligonucleotide
  Target: AGXT; (-) strand; PAM type: YTN; PAM sequence: CTA
gttggggttcttgaggcatg

SEQ ID NO: 15082 - DNA, 20 bp, Artificial Sequence
  Description of Artificial Sequence: Synthetic oligonucleotide
  Target: AGXT; (-) strand; PAM type: YTN; PAM sequence: CTC
tagttggggttcttgaggca

SEQ ID NO: 15083 - DNA, 20 bp, Artificial Sequence
  Description of Artificial Sequence: Synthetic oligonucleotide
  Target: AGXT; (-) strand; PAM type: YTN; PAM sequence: CTG
gggctctagttggggttctt

SEQ ID NO: 15084 - DNA, 20 bp, Artificial Sequence
  Description of Artificial Sequence: Synthetic oligonucleotide
  Target: AGXT; (-) strand; PAM type: YTN; PAM sequence: TTC
tggggctctagttggggttc

SEQ ID NO: 15085 - DNA, 20 bp, Artificial Sequence
  Description of Artificial Sequence: Synthetic oligonucleotide
  Target: AGXT; (-) strand; PAM type: YTN; PAM sequence: CTG
atgcaggcggattctggggc

SEQ ID NO: 15086 - DNA, 20 bp, Artificial Sequence
  Description of Artificial Sequence: Synthetic oligonucleotide
  Target: AGXT; (-) strand; PAM type: YTN; PAM sequence: CTG
cctgatgcaggcggattctg

SEQ ID NO: 15087 - DNA, 20 bp, Artificial Sequence
  Description of Artificial Sequence: Synthetic oligonucleotide
  Target: AGXT; (-) strand; PAM type: YTN; PAM sequence: TTG
actgcctgatgcaggcggat

SEQ ID NO: 15088 - DNA, 20 bp, Artificial Sequence
  Description of Artificial Sequence: Synthetic oligonucleotide
  Target: AGXT; (-) strand; PAM type: YTN; PAM sequence: TTT
gactgcctgatgcaggcgga

SEQ ID NO: 15089 - DNA, 20 bp, Artificial Sequence
  Description of Artificial Sequence: Synthetic oligonucleotide
  Target: AGXT; (-) strand; PAM type: YTN; PAM sequence: CTC
gggccagtcgaggaatgggg

SEQ ID NO: 15090 - DNA, 20 bp, Artificial Sequence
  Description of Artificial Sequence: Synthetic oligonucleotide
  Target: AGXT; (-) strand; PAM type: YTN; PAM sequence: CTG
cccagagcctcgggccagtc

SEQ ID NO: 15091 - DNA, 20 bp, Artificial Sequence
  Description of Artificial Sequence: Synthetic oligonucleotide
  Target: AGXT; (-) strand; PAM type: YTN; PAM sequence: TTG
tggaagcggcagtgggggcc

SEQ ID NO: 15092 - DNA, 20 bp, Artificial Sequence
  Description of Artificial Sequence: Synthetic oligonucleotide
  Target: AGXT; (-) strand; PAM type: YTN; PAM sequence: TTT
gtggaagcggcagtgggggc

SEQ ID NO: 15093 - DNA, 20 bp, Artificial Sequence
  Description of Artificial Sequence: Synthetic oligonucleotide
  Target: AGXT; (-) strand; PAM type: YTN; PAM sequence: CTG
gggggacagtgtttgtggaa

SEQ ID NO: 15094 - DNA, 20 bp, Artificial Sequence
  Description of Artificial Sequence: Synthetic oligonucleotide
  Target: AGXT; (-) strand; PAM type: YTN; PAM sequence: CTC
tggggggacagtgtttgtgg

SEQ ID NO: 15095 - DNA, 20 bp, Artificial Sequence
  Description of Artificial Sequence: Synthetic oligonucleotide
  Target: AGXT; (-) strand; PAM type: YTN; PAM sequence: CTG
ggacctctggggggacagtg

SEQ ID NO: 15096 - DNA, 20 bp, Artificial Sequence
  Description of Artificial Sequence: Synthetic oligonucleotide
  Target: AGXT; (-) strand; PAM type: YTN; PAM sequence: CTG
aggcccaggagtggggagat

SEQ ID NO: 15097 - DNA, 20 bp, Artificial Sequence
  Description of Artificial Sequence: Synthetic oligonucleotide
  Target: AGXT; (-) strand; PAM type: YTN; PAM sequence: TTC
agaaggggtaagctgaggcc

SEQ ID NO: 15098 - DNA, 20 bp, Artificial Sequence
  Description of Artificial Sequence: Synthetic oligonucleotide
  Target: AGXT; (-) strand; PAM type: YTN; PAM sequence: TTT
cagaaggggtaagctgaggc

SEQ ID NO: 15099 - DNA, 20 bp, Artificial Sequence
  Description of Artificial Sequence: Synthetic oligonucleotide
  Target: AGXT; (-) strand; PAM type: YTN; PAM sequence: TTT
tcagaaggggtaagctgagg

SEQ ID NO: 15100 - DNA, 20 bp, Artificial Sequence
  Description of Artificial Sequence: Synthetic oligonucleotide
  Target: AGXT; (-) strand; PAM type: YTN; PAM sequence: CTT
ttcagaaggggtaagctgag

SEQ ID NO: 15101 - DNA, 20 bp, Artificial Sequence
  Description of Artificial Sequence: Synthetic oligonucleotide
  Target: AGXT; (-) strand; PAM type: YTN; PAM sequence: TTA
tggccaaggtcgtcttttca

SEQ ID NO: 15102 - DNA, 20 bp, Artificial Sequence
  Description of Artificial Sequence: Synthetic oligonucleotide
  Target: AGXT; (-) strand; PAM type: YTN; PAM sequence: TTT
atggccaaggtcgtcttttc

SEQ ID NO: 15103 - DNA, 20 bp, Artificial Sequence
  Description of Artificial Sequence: Synthetic oligonucleotide
  Target: AGXT; (-) strand; PAM type: YTN; PAM sequence: TTG
ggtttatggccaaggtcgtc

SEQ ID NO: 15104 - DNA, 20 bp, Artificial Sequence
  Description of Artificial Sequence: Synthetic oligonucleotide
  Target: AGXT; (-) strand; PAM type: YTN; PAM sequence: CTT
gggtttatggccaaggtcgt

SEQ ID NO: 15105 - DNA, 20 bp, Artificial Sequence
  Description of Artificial Sequence: Synthetic oligonucleotide
  Target: AGXT; (-) strand; PAM type: YTN; PAM sequence: CTG
tgtgtaacataaggggcctt

SEQ ID NO: 15106 - DNA, 20 bp, Artificial Sequence
  Description of Artificial Sequence: Synthetic oligonucleotide
  Target: AGXT; (-) strand; PAM type: YTN; PAM sequence: TTC
ctgtgtgtaacataaggggc

SEQ ID NO: 15107 - DNA, 20 bp, Artificial Sequence
  Description of Artificial Sequence: Synthetic oligonucleotide
  Target: AGXT; (-) strand; PAM type: YTN; PAM sequence: TTG
ttcctgtgtgtaacataagg

SEQ ID NO: 15108 - DNA, 20 bp, Artificial Sequence
  Description of Artificial Sequence: Synthetic oligonucleotide
  Target: AGXT; (-) strand; PAM type: YTN; PAM sequence: CTT
gttcctgtgtgtaacataag

SEQ ID NO: 15109 - DNA, 20 bp, Artificial Sequence
  Description of Artificial Sequence: Synthetic oligonucleotide
  Target: AGXT; (-) strand; PAM type: YTN; PAM sequence: CTG
gcgccttgttcctgtgtgta

SEQ ID NO: 15110 - DNA, 20 bp, Artificial Sequence
  Description of Artificial Sequence: Synthetic oligonucleotide
  Target: AGXT; (-) strand; PAM type: YTN; PAM sequence: TTC
ctggcgccttgttcctgtgt

SEQ ID NO: 15111 - DNA, 20 bp, Artificial Sequence
  Description of Artificial Sequence: Synthetic oligonucleotide
  Target: AGXT; (-) strand; PAM type: YTN; PAM sequence: CTA
gggcaccattcctggcgcct

SEQ ID NO: 15112 - DNA, 20 bp, Artificial Sequence
  Description of Artificial Sequence: Synthetic oligonucleotide
  Target: AGXT; (-) strand; PAM type: YTN; PAM sequence: CTG
ggctagggcaccattcctgg

SEQ ID NO: 15113 - DNA, 20 bp, Artificial Sequence
  Description of Artificial Sequence: Synthetic oligonucleotide
  Target: AGXT; (-) strand; PAM type: YTN; PAM sequence: CTG
tgcccactgggctagggcac

SEQ ID NO: 15114 - DNA, 20 bp, Artificial Sequence
  Description of Artificial Sequence: Synthetic oligonucleotide
  Target: AGXT; (-) strand; PAM type: YTN; PAM sequence: CTC
tgtgcccactgggctagggc

SEQ ID NO: 15115 - DNA, 20 bp, Artificial Sequence
  Description of Artificial Sequence: Synthetic oligonucleotide
  Target: AGXT; (-) strand; PAM type: YTN; PAM sequence: CTG
gccctctgtgcccactgggc

SEQ ID NO: 15116 - DNA, 20 bp, Artificial Sequence
  Description of Artificial Sequence: Synthetic oligonucleotide
  Target: AGXT; (-) strand; PAM type: YTN; PAM sequence: CTG
cgaagccggcactggccctc

SEQ ID NO: 15117 - DNA, 20 bp, Artificial Sequence
  Description of Artificial Sequence: Synthetic oligonucleotide
  Target: AGXT; (-) strand; PAM type: YTN; PAM sequence: CTC
agtcccagcgtgcctgcgaa

SEQ ID NO: 15118 - DNA, 20 bp, Artificial Sequence
  Description of Artificial Sequence: Synthetic oligonucleotide
  Target: AGXT; (-) strand; PAM type: YTN; PAM sequence: CTG
cggagcccctcagtcccagc

SEQ ID NO: 15119 - DNA, 20 bp, Artificial Sequence
  Description of Artificial Sequence: Synthetic oligonucleotide
  Target: AGXT; (-) strand; PAM type: YTN; PAM sequence: CTC
cctgcggagcccctcagtcc

SEQ ID NO: 15120 - DNA, 20 bp, Artificial Sequence
  Description of Artificial Sequence: Synthetic oligonucleotide
  Target: AGXT; (-) strand; PAM type: YTN; PAM sequence: CTG
caggagcagagacacgtgcc

SEQ ID NO: 15121 - DNA, 20 bp, Artificial Sequence
  Description of Artificial Sequence: Synthetic oligonucleotide
  Target: AGXT; (-) strand; PAM type: YTN; PAM sequence: TTG
tgtagggcccagccaggagg

SEQ ID NO: 15122 - DNA, 20 bp, Artificial Sequence
  Description of Artificial Sequence: Synthetic oligonucleotide
  Target: AGXT; (-) strand; PAM type: YTN; PAM sequence: CTT
gtgtagggcccagccaggag

SEQ ID NO: 15123 - DNA, 20 bp, Artificial Sequence
  Description of Artificial Sequence: Synthetic oligonucleotide
  Target: AGXT; (-) strand; PAM type: YTN; PAM sequence: CTG
ccagggagagcatggcttgt

SEQ ID NO: 15124 - DNA, 20 bp, Artificial Sequence
  Description of Artificial Sequence: Synthetic oligonucleotide
  Target: AGXT; (-) strand; PAM type: YTN; PAM sequence: TTC
gtctgccagggagagcatgg

SEQ ID NO: 15125 - DNA, 20 bp, Artificial Sequence
  Description of Artificial Sequence: Synthetic oligonucleotide
  Target: AGXT; (-) strand; PAM type: YTN; PAM sequence: CTT
cgtctgccagggagagcatg

SEQ ID NO: 15126 - DNA, 20 bp, Artificial Sequence
  Description of Artificial Sequence: Synthetic oligonucleotide
  Target: AGXT; (-) strand; PAM type: YTN; PAM sequence: TTG
gaccgggaaggcagcttcgt

SEQ ID NO: 15127 - DNA, 20 bp, Artificial Sequence
  Description of Artificial Sequence: Synthetic oligonucleotide
  Target: AGXT; (-) strand; PAM type: YTN; PAM sequence: TTT
ggaccgggaaggcagcttcg

SEQ ID NO: 15128 - DNA, 20 bp, Artificial Sequence
  Description of Artificial Sequence: Synthetic oligonucleotide
  Target: AGXT; (-) strand; PAM type: YTN; PAM sequence: CTT
tggaccgggaaggcagcttc

SEQ ID NO: 15129 - DNA, 20 bp, Artificial Sequence
  Description of Artificial Sequence: Synthetic oligonucleotide
  Target: AGXT; (-) strand; PAM type: YTN; PAM sequence: TTC
agaactttggaccgggaagg

SEQ ID NO: 15130 - DNA, 20 bp, Artificial Sequence
  Description of Artificial Sequence: Synthetic oligonucleotide
  Target: AGXT; (-) strand; PAM type: YTN; PAM sequence: CTG
tccgggttcagaactttgga

SEQ ID NO: 15131 - DNA, 20 bp, Artificial Sequence
  Description of Artificial Sequence: Synthetic oligonucleotide
  Target: AGXT; (-) strand; PAM type: YTN; PAM sequence: CTC
cgcagaggagtcctgtccgg

SEQ ID NO: 15132 - DNA, 20 bp, Artificial Sequence
  Description of Artificial Sequence: Synthetic oligonucleotide
  Target: AGXT; (-) strand; PAM type: YTN; PAM sequence: CTG
accacaggccggtatcctcc

SEQ ID NO: 15133 - DNA, 20 bp, Artificial Sequence
  Description of Artificial Sequence: Synthetic oligonucleotide
  Target: AGXT; (-) strand; PAM type: YTN; PAM sequence: CTC
tgaccacaggccggtatcct

SEQ ID NO: 15134 - DNA, 20 bp, Artificial Sequence
  Description of Artificial Sequence: Synthetic oligonucleotide
  Target: AGXT; (-) strand; PAM type: YTN; PAM sequence: CTC
tctgaccacaggccggtatc

SEQ ID NO: 15135 - DNA, 20 bp, Artificial Sequence
  Description of Artificial Sequence: Synthetic oligonucleotide
  Target: AGXT; (-) strand; PAM type: YTN; PAM sequence: CTG
ccccagccccaacagcacag

SEQ ID NO: 15136 - DNA, 20 bp, Artificial Sequence
  Description of Artificial Sequence: Synthetic oligonucleotide
  Target: AGXT; (-) strand; PAM type: YTN; PAM sequence: CTG
tctgccccagccccaacagc

SEQ ID NO: 15137 - DNA, 20 bp, Artificial Sequence
  Description of Artificial Sequence: Synthetic oligonucleotide
  Target: AGXT; (-) strand; PAM type: YTN; PAM sequence: CTC
tgtctgccccagccccaaca

SEQ ID NO: 15138 - DNA, 20 bp, Artificial Sequence
  Description of Artificial Sequence: Synthetic oligonucleotide
  Target: AGXT; (-) strand; PAM type: YTN; PAM sequence: TTA
gctctgtctgccccagcccc

SEQ ID NO: 15139 - DNA, 20 bp, Artificial Sequence
  Description of Artificial Sequence: Synthetic oligonucleotide
  Target: AGXT; (-) strand; PAM type: YTN; PAM sequence: TTG
ggggcagatggggcattagc

SEQ ID NO: 15140 - DNA, 20 bp, Artificial Sequence
  Description of Artificial Sequence: Synthetic oligonucleotide
  Target: AGXT; (-) strand; PAM type: YTN; PAM sequence: TTG
gtccagcaccatgggcaggg

SEQ ID NO: 15141 - DNA, 20 bp, Artificial Sequence
  Description of Artificial Sequence: Synthetic oligonucleotide
  Target: AGXT; (-) strand; PAM type: YTN; PAM sequence: CTT
ggtccagcaccatgggcagg

SEQ ID NO: 15142 - DNA, 20 bp, Artificial Sequence
  Description of Artificial Sequence: Synthetic oligonucleotide
  Target: AGXT; (-) strand; PAM type: YTN; PAM sequence: CTG
gaagacacgagggggcttgg

SEQ ID NO: 15143 - DNA, 20 bp, Artificial Sequence
  Description of Artificial Sequence: Synthetic oligonucleotide
  Target: AGXT; (-) strand; PAM type: YTN; PAM sequence: TTG
tgtgatggtacctggaagac

SEQ ID NO: 15144 - DNA, 20 bp, Artificial Sequence
  Description of Artificial Sequence: Synthetic oligonucleotide
  Target: AGXT; (-) strand; PAM type: YTN; PAM sequence: CTG
atgacggggattgtgtgatg

SEQ ID NO: 15145 - DNA, 20 bp, Artificial Sequence
  Description of Artificial Sequence: Synthetic oligonucleotide
  Target: AGXT; (-) strand; PAM type: YTN; PAM sequence: CTG
tacaggctgatgacggggat

SEQ ID NO: 15146 - DNA, 20 bp, Artificial Sequence
  Description of Artificial Sequence: Synthetic oligonucleotide
  Target: AGXT; (-) strand; PAM type: YTN; PAM sequence: CTC
aggctgtacaggctgatgac

SEQ ID NO: 15147 - DNA, 20 bp, Artificial Sequence
  Description of Artificial Sequence: Synthetic oligonucleotide
  Target: AGXT; (-) strand; PAM type: YTN; PAM sequence: CTC
tcaggctgtacaggctgatg

SEQ ID NO: 15148 - DNA, 20 bp, Artificial Sequence
  Description of Artificial Sequence: Synthetic oligonucleotide
  Target: AGXT; (-) strand; PAM type: YTN; PAM sequence: CTC
tctcaggctgtacaggctga

SEQ ID NO: 15149 - DNA, 20 bp, Artificial Sequence
  Description of Artificial Sequence: Synthetic oligonucleotide
  Target: AGXT; (-) strand; PAM type: YTN; PAM sequence: CTC
tctctcaggctgtacaggct

SEQ ID NO: 15150 - DNA, 20 bp, Artificial Sequence
  Description of Artificial Sequence: Synthetic oligonucleotide
  Target: AGXT; (-) strand; PAM type: YTN; PAM sequence: TTC
cgcaatgagggccaggctct

SEQ ID NO: 15151 - DNA, 20 bp, Artificial Sequence
  Description of Artificial Sequence: Synthetic oligonucleotide
  Target: AGXT; (-) strand; PAM type: YTN; PAM sequence: CTG
ttccgcaatgagggccaggc

SEQ ID NO: 15152 - DNA, 20 bp, Artificial Sequence
  Description of Artificial Sequence: Synthetic oligonucleotide
  Target: AGXT; (-) strand; PAM type: YTN; PAM sequence: CTG
tggagtgcagcccatgcacc

SEQ ID NO: 15153 - DNA, 20 bp, Artificial Sequence
  Description of Artificial Sequence: Synthetic oligonucleotide
  Target: AGXT; (-) strand; PAM type: YTN; PAM sequence: CTC
ctgtggagtgcagcccatgc

SEQ ID NO: 15154 - DNA, 20 bp, Artificial Sequence
  Description of Artificial Sequence: Synthetic oligonucleotide
  Target: AGXT; (-) strand; PAM type: YTN; PAM sequence: CTC
ctcctgtggagtgcagccca

SEQ ID NO: 15155 - DNA, 20 bp, Artificial Sequence
  Description of Artificial Sequence: Synthetic oligonucleotide
  Target: AGXT; (-) strand; PAM type: YTN; PAM sequence: CTG
tctcctcctgtggagtgcag

SEQ ID NO: 15156 - DNA, 20 bp, Artificial Sequence
  Description of Artificial Sequence: Synthetic oligonucleotide
  Target: AGXT; (-) strand; PAM type: YTN; PAM sequence: CTC
gacaatccagccagtggccc

SEQ ID NO: 15157 - DNA, 20 bp, Artificial Sequence
  Description of Artificial Sequence: Synthetic oligonucleotide
  Target: AGXT; (-) strand; PAM type: YTN; PAM sequence: CTG
caggccgcgccctcgacaat

SEQ ID NO: 15158 - DNA, 20 bp, Artificial Sequence
  Description of Artificial Sequence: Synthetic oligonucleotide
  Target: AGXT; (-) strand; PAM type: YTN; PAM sequence: CTC
tgcaggccgcgccctcgaca

SEQ ID NO: 15159 - DNA, 20 bp, Artificial Sequence
  Description of Artificial Sequence: Synthetic oligonucleotide
  Target: AGXT; (-) strand; PAM type: YTN; PAM sequence: TTC
tctgcaggccgcgccctcga

SEQ ID NO: 15160 - DNA, 20 bp, Artificial Sequence
  Description of Artificial Sequence: Synthetic oligonucleotide
  Target: AGXT; (-) strand; PAM type: YTN; PAM sequence: CTT
ctctgcaggccgcgccctcg

SEQ ID NO: 15161 - DNA, 20 bp, Artificial Sequence
  Description of Artificial Sequence: Synthetic oligonucleotide
  Target: AGXT; (-) strand; PAM type: YTN; PAM sequence: TTC
cttctctgcaggccgcgccc

SEQ ID NO: 15162 - DNA, 20 bp, Artificial Sequence
  Description of Artificial Sequence: Synthetic oligonucleotide
  Target: AGXT; (-) strand; PAM type: YTN; PAM sequence: CTG
tgcaccagggatggttcctt

SEQ ID NO: 15163 - DNA, 20 bp, Artificial Sequence
  Description of Artificial Sequence: Synthetic oligonucleotide
  Target: AGXT; (-) strand; PAM type: YTN; PAM sequence: CTC
tgtgcaccagggatggttcc

SEQ ID NO: 15164 - DNA, 20 bp, Artificial Sequence
  Description of Artificial Sequence: Synthetic oligonucleotide
  Target: AGXT; (-) strand; PAM type: YTN; PAM sequence: TTC
tctgtgcaccagggatggtt

SEQ ID NO: 15165 - DNA, 20 bp, Artificial Sequence
  Description of Artificial Sequence: Synthetic oligonucleotide
  Target: AGXT; (-) strand; PAM type: YTN; PAM sequence: TTT
ctctgtgcaccagggatggt

SEQ ID NO: 15166 - DNA, 20 bp, Artificial Sequence
  Description of Artificial Sequence: Synthetic oligonucleotide
  Target: AGXT; (-) strand; PAM type: YTN; PAM sequence: TTT
tctctgtgcaccagggatgg

SEQ ID NO: 15167 - DNA, 20 bp, Artificial Sequence
  Description of Artificial Sequence: Synthetic oligonucleotide
  Target: AGXT; (-) strand; PAM type: YTN; PAM sequence: CTT
ttctctgtgcaccagggatg

SEQ ID NO: 15168 - DNA, 20 bp, Artificial Sequence
  Description of Artificial Sequence: Synthetic oligonucleotide
  Target: AGXT; (-) strand; PAM type: YTN; PAM sequence: CTC
ccttttctctgtgcaccagg

SEQ ID NO: 15169 - DNA, 20 bp, Artificial Sequence
  Description of Artificial Sequence: Synthetic oligonucleotide
  Target: AGXT; (-) strand; PAM type: YTN; PAM sequence: CTG
gcaggctcccttttctctgt

SEQ ID NO: 15170 - DNA, 20 bp, Artificial Sequence
  Description of Artificial Sequence: Synthetic oligonucleotide
  Target: AGXT; (-) strand; PAM type: YTN; PAM sequence: CTC
tggcaggctcccttttctct

SEQ ID NO: 15171 - DNA, 20 bp, Artificial Sequence
  Description of Artificial Sequence: Synthetic oligonucleotide
  Target: AGXT; (-) strand; PAM type: YTN; PAM sequence: CTC
tctggcaggctcccttttct

SEQ ID NO: 15172 - DNA, 20 bp, Artificial Sequence
  Description of Artificial Sequence: Synthetic oligonucleotide
  Target: AGXT; (-) strand; PAM type: YTN; PAM sequence: CTC
tctctggcaggctccctttt

SEQ ID NO: 15173 - DNA, 20 bp, Artificial Sequence
  Description of Artificial Sequence: Synthetic oligonucleotide
  Target: AGXT; (-) strand; PAM type: YTN; PAM sequence: CTG
agggcctctctctggcaggc

SEQ ID NO: 15174 - DNA, 20 bp, Artificial Sequence
  Description of Artificial Sequence: Synthetic oligonucleotide
  Target: AGXT; (-) strand; PAM type: YTN; PAM sequence: CTC
ccccacccccactgagggcc

SEQ ID NO: 15175 - DNA, 20 bp, Artificial Sequence
  Description of Artificial Sequence: Synthetic oligonucleotide
  Target: AGXT; (-) strand; PAM type: YTN; PAM sequence: CTC
tcccccacccccactgaggg

SEQ ID NO: 15176 - DNA, 20 bp, Artificial Sequence
  Description of Artificial Sequence: Synthetic oligonucleotide
  Target: AGXT; (-) strand; PAM type: YTN; PAM sequence: CTC
tctcccccacccccactgag

SEQ ID NO: 15177 - DNA, 20 bp, Artificial Sequence
  Description of Artificial Sequence: Synthetic oligonucleotide
  Target: AGXT; (-) strand; PAM type: YTN; PAM sequence: CTG
tcctctctcccccaccccca

SEQ ID NO: 15178 - DNA, 20 bp, Artificial Sequence
  Description of Artificial Sequence: Synthetic oligonucleotide
  Target: AGXT; (-) strand; PAM type: YTN; PAM sequence: CTG
cccgcagccagtgtacccgg

SEQ ID NO: 15179 - DNA, 20 bp, Artificial Sequence
  Description of Artificial Sequence: Synthetic oligonucleotide
  Target: AGXT; (-) strand; PAM type: YTN; PAM sequence: CTG
gccctgcccgcagccagtgt

SEQ ID NO: 15180 - DNA, 20 bp, Artificial Sequence
  Description of Artificial Sequence: Synthetic oligonucleotide
  Target: AGXT; (-) strand; PAM type: YTN; PAM sequence: CTG
tatccccctggccctgcccg

SEQ ID NO: 15181 - DNA, 20 bp, Artificial Sequence
  Description of Artificial Sequence: Synthetic oligonucleotide
  Target: AGXT; (-) strand; PAM type: YTN; PAM sequence: CTG
gggctgtatccccctggccc

SEQ ID NO: 15182 - DNA, 20 bp, Artificial Sequence
  Description of Artificial Sequence: Synthetic oligonucleotide
  Target: AGXT; (-) strand; PAM type: YTN; PAM sequence: CTG
tccctggggctgtatccccc

SEQ ID NO: 15183 - DNA, 20 bp, Artificial Sequence
  Description of Artificial Sequence: Synthetic oligonucleotide
  Target: AGXT; (-) strand; PAM type: YTN; PAM sequence: CTG
catctgtccctggggctgta

SEQ ID NO: 15184 - DNA, 20 bp, Artificial Sequence
  Description of Artificial Sequence: Synthetic oligonucleotide
  Target: AGXT; (-) strand; PAM type: YTN; PAM sequence: TTG
ctgcatctgtccctggggct

SEQ ID NO: 15185 - DNA, 20 bp, Artificial Sequence
  Description of Artificial Sequence: Synthetic oligonucleotide
  Target: AGXT; (-) strand; PAM type: YTN; PAM sequence: CTG
ccccattgctgcatctgtcc

SEQ ID NO: 15186 - DNA, 20 bp, Artificial Sequence
  Description of Artificial Sequence: Synthetic oligonucleotide
  Target: AGXT; (-) strand; PAM type: YTN; PAM sequence: TTG
ggagcatccacacctgcccc

SEQ ID NO: 15187 - DNA, 20 bp, Artificial Sequence
  Description of Artificial Sequence: Synthetic oligonucleotide
  Target: AGXT; (-) strand; PAM type: YTN; PAM sequence: TTC
acacagcaatggaagggttg

SEQ ID NO: 15188 - DNA, 20 bp, Artificial Sequence
  Description of Artificial Sequence: Synthetic oligonucleotide
  Target: AGXT; (-) strand; PAM type: YTN; PAM sequence: CTT
cacacagcaatggaagggtt

SEQ ID NO: 15189 - DNA, 20 bp, Artificial Sequence
  Description of Artificial Sequence: Synthetic oligonucleotide
  Target: AGXT; (-) strand; PAM type: YTN; PAM sequence: CTG
cttcacacagcaatggaagg

SEQ ID NO: 15190 - DNA, 20 bp, Artificial Sequence
  Description of Artificial Sequence: Synthetic oligonucleotide
  Target: AGXT; (-) strand; PAM type: YTN; PAM sequence: TTA
ctgcttcacacagcaatgga

SEQ ID NO: 15191 - DNA, 20 bp, Artificial Sequence
  Description of Artificial Sequence: Synthetic oligonucleotide
  Target: AGXT; (-) strand; PAM type: YTN; PAM sequence: CTT
actgcttcacacagcaatgg

SEQ ID NO: 15192 - DNA, 20 bp, Artificial Sequence
  Description of Artificial Sequence: Synthetic oligonucleotide
  Target: AGXT; (-) strand; PAM type: YTN; PAM sequence: CTC
acttactgcttcacacagca

SEQ ID NO: 15193 - DNA, 20 bp, Artificial Sequence
  Description of Artificial Sequence: Synthetic oligonucleotide
  Target: AGXT; (-) strand; PAM type: YTN; PAM sequence: CTG
ggcctcacttactgcttcac

SEQ ID NO: 15194 - DNA, 20 bp, Artificial Sequence
  Description of Artificial Sequence: Synthetic oligonucleotide
  Target: AGXT; (-) strand; PAM type: YTN; PAM sequence: CTC
actgggcctcacttactgct

SEQ ID NO: 15195 - DNA, 20 bp, Artificial Sequence
  Description of Artificial Sequence: Synthetic oligonucleotide
  Target: AGXT; (-) strand; PAM type: YTN; PAM sequence: CTC
ccagcccacccactcactgg

SEQ ID NO: 15196 - DNA, 20 bp, Artificial Sequence
  Description of Artificial Sequence: Synthetic oligonucleotide
  Target: AGXT; (-) strand; PAM type: YTN; PAM sequence: TTC
tcccagcccacccactcact

SEQ ID NO: 15197 - DNA, 20 bp, Artificial Sequence
  Description of Artificial Sequence: Synthetic oligonucleotide
  Target: AGXT; (-) strand; PAM type: YTN; PAM sequence: CTT
ctcccagcccacccactcac

SEQ ID NO: 15198 - DNA, 20 bp, Artificial Sequence
  Description of Artificial Sequence: Synthetic oligonucleotide
  Target: AGXT; (-) strand; PAM type: YTN; PAM sequence: CTC
cccttctcccagcccaccca

SEQ ID NO: 15199 - DNA, 20 bp, Artificial Sequence
  Description of Artificial Sequence: Synthetic oligonucleotide
  Target: AGXT; (-) strand; PAM type: YTN; PAM sequence: TTC
ggcctccccttctcccagcc

SEQ ID NO: 15200 - DNA, 20 bp, Artificial Sequence
  Description of Artificial Sequence: Synthetic oligonucleotide
  Target: AGXT; (-) strand; PAM type: YTN; PAM sequence: CTT
cggcctccccttctcccagc

SEQ ID NO: 15201 - DNA, 20 bp, Artificial Sequence
  Description of Artificial Sequence: Synthetic oligonucleotide
  Target: AGXT; (-) strand; PAM type: YTN; PAM sequence: CTG
gccccttcggcctccccttc

SEQ ID NO: 15202 - DNA, 20 bp, Artificial Sequence
  Description of Artificial Sequence: Synthetic oligonucleotide
  Target: AGXT; (-) strand; PAM type: YTN; PAM sequence: CTC
tggccccttcggcctcccct

SEQ ID NO: 15203 - DNA, 20 bp, Artificial Sequence
  Description of Artificial Sequence: Synthetic oligonucleotide
  Target: AGXT; (-) strand; PAM type: YTN; PAM sequence: CTG
tgggcacatctctggcccct

SEQ ID NO: 15204 - DNA, 20 bp, Artificial Sequence
  Description of Artificial Sequence: Synthetic oligonucleotide
  Target: AGXT; (-) strand; PAM type: YTN; PAM sequence: CTA
tctgtgggcacatctctggc

SEQ ID NO: 15205 - DNA, 20 bp, Artificial Sequence
  Description of Artificial Sequence: Synthetic oligonucleotide
  Target: AGXT; (-) strand; PAM type: YTN; PAM sequence: TTA
catccacgcccacctatctg

SEQ ID NO: 15206 - DNA, 20 bp, Artificial Sequence
  Description of Artificial Sequence: Synthetic oligonucleotide
  Target: AGXT; (-) strand; PAM type: YTN; PAM sequence: TTT
acatccacgcccacctatct

SEQ ID NO: 15207 - DNA, 20 bp, Artificial Sequence
  Description of Artificial Sequence: Synthetic oligonucleotide
  Target: AGXT; (-) strand; PAM type: YTN; PAM sequence: CTT
tacatccacgcccacctatc

SEQ ID NO: 15208 - DNA, 20 bp, Artificial Sequence
  Description of Artificial Sequence: Synthetic oligonucleotide
  Target: AGXT; (-) strand; PAM type: YTN; PAM sequence: CTC
actttacatccacgcccacc

SEQ ID NO: 15209 - DNA, 20 bp, Artificial Sequence
  Description of Artificial Sequence: Synthetic oligonucleotide
  Target: AGXT; (-) strand; PAM type: YTN; PAM sequence: CTG
ccaaccctcactttacatcc

SEQ ID NO: 15210 - DNA, 20 bp, Artificial Sequence
  Description of Artificial Sequence: Synthetic oligonucleotide
  Target: AGXT; (-) strand; PAM type: YTN; PAM sequence: CTG
caggaactgccaaccctcac

SEQ ID NO: 15211 - DNA, 20 bp, Artificial Sequence
  Description of Artificial Sequence: Synthetic oligonucleotide
  Target: AGXT; (-) strand; PAM type: YTN; PAM sequence: CTG
gacaagcctgcaggaactgc

SEQ ID NO: 15212 - DNA, 20 bp, Artificial Sequence
  Description of Artificial Sequence: Synthetic oligonucleotide
  Target: AGXT; (-) strand; PAM type: YTN; PAM sequence: CTG
ccataggagctggacaagcc

SEQ ID NO: 15213 - DNA, 20 bp, Artificial Sequence
  Description of Artificial Sequence: Synthetic oligonucleotide
  Target: AGXT; (-) strand; PAM type: YTN; PAM sequence: TTG
ccctgccataggagctggac

SEQ ID NO: 15214 - DNA, 20 bp, Artificial Sequence
  Description of Artificial Sequence: Synthetic oligonucleotide
  Target: AGXT; (-) strand; PAM type: YTN; PAM sequence: CTT
gccctgccataggagctgga

SEQ ID NO: 15215 - DNA, 20 bp, Artificial Sequence
  Description of Artificial Sequence: Synthetic oligonucleotide
  Target: AGXT; (-) strand; PAM type: YTN; PAM sequence: CTC
ttgccctgccataggagctg

SEQ ID NO: 15216 - DNA, 20 bp, Artificial Sequence
  Description of Artificial Sequence: Synthetic oligonucleotide
  Target: AGXT; (-) strand; PAM type: YTN; PAM sequence: CTC
agctcttgccctgccatagg

SEQ ID NO: 15217 - DNA, 20 bp, Artificial Sequence
  Description of Artificial Sequence: Synthetic oligonucleotide
  Target: AGXT; (-) strand; PAM type: YTN; PAM sequence: CTC
atgctcagctcttgccctgc

SEQ ID NO: 15218 - DNA, 20 bp, Artificial Sequence
  Description of Artificial Sequence: Synthetic oligonucleotide
  Target: AGXT; (-) strand; PAM type: YTN; PAM sequence: CTG
gtcacacccaagtgctcatg

SEQ ID NO: 15219 - DNA, 20 bp, Artificial Sequence
  Description of Artificial Sequence: Synthetic oligonucleotide
  Target: AGXT; (-) strand; PAM type: YTN; PAM sequence: TTG
cagtggccaaatcaacccct

SEQ ID NO: 15220 - DNA, 20 bp, Artificial Sequence
  Description of Artificial Sequence: Synthetic oligonucleotide
  Target: AGXT; (-) strand; PAM type: YTN; PAM sequence: CTG
agagtgtggatgttgcagtg

SEQ ID NO: 15221 - DNA, 20 bp, Artificial Sequence
  Description of Artificial Sequence: Synthetic oligonucleotide
  Target: AGXT; (-) strand; PAM type: YTN; PAM sequence: TTG
cagtgtcctgagagtgtgga

SEQ ID NO: 15222 - DNA, 20 bp, Artificial Sequence
  Description of Artificial Sequence: Synthetic oligonucleotide
  Target: AGXT; (-) strand; PAM type: YTN; PAM sequence: CTG
agagtgtggatgttgcagtg

SEQ ID NO: 15223 - DNA, 20 bp, Artificial Sequence
  Description of Artificial Sequence: Synthetic oligonucleotide
  Target: AGXT; (-) strand; PAM type: YTN; PAM sequence: CTG
tgtcctgagagtgtggatgt

SEQ ID NO: 15224 - DNA, 20 bp, Artificial Sequence
  Description of Artificial Sequence: Synthetic oligonucleotide
  Target: AGXT; (-) strand; PAM type: YTN; PAM sequence: CTC
agccgcctgtgtcctgagag

SEQ ID NO: 15225 - DNA, 20 bp, Artificial Sequence
  Description of Artificial Sequence: Synthetic oligonucleotide
  Target: AGXT; (-) strand; PAM type: YTN; PAM sequence: CTC
tcagccgcctgtgtcctgag

SEQ ID NO: 15226 - DNA, 20 bp, Artificial Sequence
  Description of Artificial Sequence: Synthetic oligonucleotide
  Target: AGXT; (-) strand; PAM type: YTN; PAM sequence: CTG
aggccactctcagccgcctg

SEQ ID NO: 15227 - DNA, 20 bp, Artificial Sequence
  Description of Artificial Sequence: Synthetic oligonucleotide
  Target: AGXT; (-) strand; PAM type: YTN; PAM sequence: CTG
ggcctgaggccactctcagc

SEQ ID NO: 15228 - DNA, 20 bp, Artificial Sequence
  Description of Artificial Sequence: Synthetic oligonucleotide
  Target: AGXT; (-) strand; PAM type: YTN; PAM sequence: CTG
ctgggcctgaggccactctc

SEQ ID NO: 15229 - DNA, 20 bp, Artificial Sequence
  Description of Artificial Sequence: Synthetic oligonucleotide
  Target: AGXT; (-) strand; PAM type: YTN; PAM sequence: CTG
cagagctgctgggcctgagg

SEQ ID NO: 15230 - DNA, 20 bp, Artificial Sequence
  Description of Artificial Sequence: Synthetic oligonucleotide
  Target: AGXT; (-) strand; PAM type: YTN; PAM sequence: CTC
gtggcctgcagagctgctgg

SEQ ID NO: 15231 - DNA, 20 bp, Artificial Sequence
  Description of Artificial Sequence: Synthetic oligonucleotide
  Target: AGXT; (-) strand; PAM type: YTN; PAM sequence: CTG
tctcgtggcctgcagagctg

SEQ ID NO: 15232 - DNA, 20 bp, Artificial Sequence
  Description of Artificial Sequence: Synthetic oligonucleotide
  Target: AGXT; (-) strand; PAM type: YTN; PAM sequence: TTC
ctgtctcgtggcctgcagag

SEQ ID NO: 15233 - DNA, 20 bp, Artificial Sequence
  Description of Artificial Sequence: Synthetic oligonucleotide
  Target: AGXT; (-) strand; PAM type: YTN; PAM sequence: CTT
cctgtctcgtggcctgcaga

SEQ ID NO: 15234 - DNA, 20 bp, Artificial Sequence
  Description of Artificial Sequence: Synthetic oligonucleotide
  Target: AGXT; (-) strand; PAM type: YTN; PAM sequence: CTG
tgggacacaggacccagatg

SEQ ID NO: 15235 - DNA, 20 bp, Artificial Sequence
  Description of Artificial Sequence: Synthetic oligonucleotide
  Target: AGXT; (-) strand; PAM type: YTN; PAM sequence: CTG
gcaatgggccctgtgggaca

SEQ ID NO: 15236 - DNA, 20 bp, Artificial Sequence
  Description of Artificial Sequence: Synthetic oligonucleotide
  Target: AGXT; (-) strand; PAM type: YTN; PAM sequence: CTG
gtggctggcaatgggccctg

SEQ ID NO: 15237 - DNA, 20 bp, Artificial Sequence
  Description of Artificial Sequence: Synthetic oligonucleotide
  Target: AGXT; (-) strand; PAM type: YTN; PAM sequence: CTG
gactggtggctggcaatggg

SEQ ID NO: 15238 - DNA, 20 bp, Artificial Sequence
  Description of Artificial Sequence: Synthetic oligonucleotide
  Target: AGXT; (-) strand; PAM type: YTN; PAM sequence: CTC
tggactggtggctggcaatg

SEQ ID NO: 15239 - DNA, 20 bp, Artificial Sequence
  Description of Artificial Sequence: Synthetic oligonucleotide
  Target: AGXT; (-) strand; PAM type: YTN; PAM sequence: CTG
gactctggactggtggctgg

SEQ ID NO: 15240 - DNA, 20 bp, Artificial Sequence
  Description of Artificial Sequence: Synthetic oligonucleotide
  Target: AGXT; (-) strand; PAM type: YTN; PAM sequence: TTC
ctggactctggactggtggc

SEQ ID NO: 15241 - DNA, 20 bp, Artificial Sequence
  Description of Artificial Sequence: Synthetic oligonucleotide
  Target: AGXT; (-) strand; PAM type: YTN; PAM sequence: CTT
cctggactctggactggtgg

SEQ ID NO: 15242 - DNA, 20 bp, Artificial Sequence
  Description of Artificial Sequence: Synthetic oligonucleotide
  Target: AGXT; (-) strand; PAM type: YTN; PAM sequence: CTG
cagcccggggatccttcctg

SEQ ID NO: 15243 - DNA, 20 bp, Artificial Sequence
  Description of Artificial Sequence: Synthetic oligonucleotide
  Target: AGXT; (-) strand; PAM type: YTN; PAM sequence: CTG
gctgcagcccggggatcctt

SEQ ID NO: 15244 - DNA, 20 bp, Artificial Sequence
  Description of Artificial Sequence: Synthetic oligonucleotide
  Target: AGXT; (-) strand; PAM type: YTN; PAM sequence: CTC
atgggaagctggctgcagcc

SEQ ID NO: 15245 - DNA, 20 bp, Artificial Sequence
  Description of Artificial Sequence: Synthetic oligonucleotide
  Target: AGXT; (-) strand; PAM type: YTN; PAM sequence: TTG
caacctcatgggaagctggc

SEQ ID NO: 15246 - DNA, 20 bp, Artificial Sequence
  Description of Artificial Sequence: Synthetic oligonucleotide
  Target: AGXT; (-) strand; PAM type: YTN; PAM sequence: CTT
gcaacctcatgggaagctgg

SEQ ID NO: 15247 - DNA, 20 bp, Artificial Sequence
  Description of Artificial Sequence: Synthetic oligonucleotide
  Target: AGXT; (-) strand; PAM type: YTN; PAM sequence: TTA
tgagtggacccaggaggaca

SEQ ID NO: 15248 - DNA, 20 bp, Artificial Sequence
  Description of Artificial Sequence: Synthetic oligonucleotide
  Target: AGXT; (-) strand; PAM type: YTN; PAM sequence: TTT
atgagtggacccaggaggac

SEQ ID NO: 15249 - DNA, 20 bp, Artificial Sequence
  Description of Artificial Sequence: Synthetic oligonucleotide
  Target: AGXT; (-) strand; PAM type: YTN; PAM sequence: CTT
tatgagtggacccaggagga

SEQ ID NO: 15250 - DNA, 20 bp, Artificial Sequence
  Description of Artificial Sequence: Synthetic oligonucleotide
  Target: AGXT; (-) strand; PAM type: YTN; PAM sequence: CTA
ggcagtggctttatgagtgg

SEQ ID NO: 15251 - DNA, 20 bp, Artificial Sequence
  Description of Artificial Sequence: Synthetic oligonucleotide
  Target: AGXT; (-) strand; PAM type: YTN; PAM sequence: CTA
acccagccctaggcagtggc

SEQ ID NO: 15252 - DNA, 20 bp, Artificial Sequence
  Description of Artificial Sequence: Synthetic oligonucleotide
  Target: AGXT; (-) strand; PAM type: YTN; PAM sequence: CTG
gcactaacccagccctaggc

SEQ ID NO: 15253 - DNA, 20 bp, Artificial Sequence
  Description of Artificial Sequence: Synthetic oligonucleotide
  Target: AGXT; (-) strand; PAM type: YTN; PAM sequence: TTA
caggggcaccctggcactaa

SEQ ID NO: 15254 - DNA, 20 bp, Artificial Sequence
  Description of Artificial Sequence: Synthetic oligonucleotide
  Target: AGXT; (-) strand; PAM type: YTN; PAM sequence: CTT
acaggggcaccctggcacta

SEQ ID NO: 15255 - DNA, 20 bp, Artificial Sequence
  Description of Artificial Sequence: Synthetic oligonucleotide
  Target: AGXT; (-) strand; PAM type: YTN; PAM sequence: TTA
gcttacaggggcaccctggc

SEQ ID NO: 15256 - DNA, 20 bp, Artificial Sequence
  Description of Artificial Sequence: Synthetic oligonucleotide
  Target: AGXT; (-) strand; PAM type: YTN; PAM sequence: TTT
agcttacaggggcaccctgg

SEQ ID NO: 15257 - DNA, 20 bp, Artificial Sequence
  Description of Artificial Sequence: Synthetic oligonucleotide
  Target: AGXT; (-) strand; PAM type: YTN; PAM sequence: TTC
ccccgcgggtgcgggtggca

SEQ ID NO: 15258 - DNA, 20 bp, Artificial Sequence
  Description of Artificial Sequence: Synthetic oligonucleotide
  Target: AGXT; (-) strand; PAM type: YTN; PAM sequence: CTT
cccccgcgggtgcgggtggc

SEQ ID NO: 15259 - DNA, 20 bp, Artificial Sequence
  Description of Artificial Sequence: Synthetic oligonucleotide
  Target: AGXT; (-) strand; PAM type: YTN; PAM sequence: CTC
gccttcccccgcgggtgcgg

SEQ ID NO: 15260 - DNA, 20 bp, Artificial Sequence
  Description of Artificial Sequence: Synthetic oligonucleotide
  Target: AGXT; (-) strand; PAM type: YTN; PAM sequence: CTG
acccctcgccttcccccgcg

SEQ ID NO: 15261 - DNA, 20 bp, Artificial Sequence
  Description of Artificial Sequence: Synthetic oligonucleotide
  Target: AGXT; (-) strand; PAM type: YTN; PAM sequence: CTG
tgtgagcgcctgacccctcg

SEQ ID NO: 15262 - DNA, 20 bp, Artificial Sequence
  Description of Artificial Sequence: Synthetic oligonucleotide
  Target: AGXT; (-) strand; PAM type: YTN; PAM sequence: TTC
cctgtgtgagcgcctgaccc

SEQ ID NO: 15263 - DNA, 20 bp, Artificial Sequence
  Description of Artificial Sequence: Synthetic oligonucleotide
  Target: AGXT; (-) strand; PAM type: YTN; PAM sequence: TTT
ccctgtgtgagcgcctgacc

SEQ ID NO: 15264 - DNA, 20 bp, Artificial Sequence
  Description of Artificial Sequence: Synthetic oligonucleotide
  Target: AGXT; (-) strand; PAM type: YTN; PAM sequence: CTT
tccctgtgtgagcgcctgac

SEQ ID NO: 15265 - DNA, 20 bp, Artificial Sequence
  Description of Artificial Sequence: Synthetic oligonucleotide
  Target: AGXT; (-) strand; PAM type: YTN; PAM sequence: CTA
gagcctttccctgtgtgagc

SEQ ID NO: 15266 - DNA, 20 bp, Artificial Sequence
  Description of Artificial Sequence: Synthetic oligonucleotide
  Target: AGXT; (-) strand; PAM type: YTN; PAM sequence: TTA
cgaccctagagcctttccct

SEQ ID NO: 15267 - DNA, 20 bp, Artificial Sequence
  Description of Artificial Sequence: Synthetic oligonucleotide
  Target: AGXT; (-) strand; PAM type: YTN; PAM sequence: TTT
acgaccctagagcctttccc

SEQ ID NO: 15268 - DNA, 20 bp, Artificial Sequence
  Description of Artificial Sequence: Synthetic oligonucleotide
  Target: AGXT; (-) strand; PAM type: YTN; PAM sequence: CTT
tacgaccctagagcctttcc

SEQ ID NO: 15269 - DNA, 20 bp, Artificial Sequence
  Description of Artificial Sequence: Synthetic oligonucleotide
  Target: AGXT; (-) strand; PAM type: YTN; PAM sequence: CTC
acaccccccacccaccttta

SEQ ID NO: 15270 - DNA, 20 bp, Artificial Sequence
  Description of Artificial Sequence: Synthetic oligonucleotide
  Target: AGXT; (-) strand; PAM type: YTN; PAM sequence: CTG
cccagctcacaccccccacc

SEQ ID NO: 15271 - DNA, 20 bp, Artificial Sequence
  Description of Artificial Sequence: Synthetic oligonucleotide
  Target: AGXT; (-) strand; PAM type: YTN; PAM sequence: CTC
tgcccagctcacacccccca

SEQ ID NO: 15272 - DNA, 20 bp, Artificial Sequence
  Description of Artificial Sequence: Synthetic oligonucleotide
  Target: AGXT; (-) strand; PAM type: YTN; PAM sequence: TTC
tctgcccagctcacaccccc

SEQ ID NO: 15273 - DNA, 20 bp, Artificial Sequence
  Description of Artificial Sequence: Synthetic oligonucleotide
  Target: AGXT; (-) strand; PAM type: YTN; PAM sequence: CTT
ctctgcccagctcacacccc

SEQ ID NO: 15274 - DNA, 20 bp, Artificial Sequence
  Description of Artificial Sequence: Synthetic oligonucleotide
  Target: AGXT; (-) strand; PAM type: YTN; PAM sequence: TTC
cttctctgcccagctcacac

SEQ ID NO: 15275 - DNA, 20 bp, Artificial Sequence
  Description of Artificial Sequence: Synthetic oligonucleotide
  Target: AGXT; (-) strand; PAM type: YTN; PAM sequence: CTT
ccttctctgcccagctcaca

SEQ ID NO: 15276 - DNA, 20 bp, Artificial Sequence
  Description of Artificial Sequence: Synthetic oligonucleotide
  Target: AGXT; (-) strand; PAM type: YTN; PAM sequence: CTC
ttccttctctgcccagctca

SEQ ID NO: 15277 - DNA, 20 bp, Artificial Sequence
  Description of Artificial Sequence: Synthetic oligonucleotide
  Target: AGXT; (-) strand; PAM type: YTN; PAM sequence: TTC
tcttccttctctgcccagct

SEQ ID NO: 15278 - DNA, 20 bp, Artificial Sequence
  Description of Artificial Sequence: Synthetic oligonucleotide
  Target: AGXT; (-) strand; PAM type: YTN; PAM sequence: CTG
ttctcttccttctctgccca

SEQ ID NO: 15279 - DNA, 20 bp, Artificial Sequence
  Description of Artificial Sequence: Synthetic oligonucleotide
  Target: AGXT; (-) strand; PAM type: YTN; PAM sequence: CTG
gtcctgttctcttccttctc

SEQ ID NO: 15280 - DNA, 20 bp, Artificial Sequence
  Description of Artificial Sequence: Synthetic oligonucleotide
  Target: AGXT; (-) strand; PAM type: YTN; PAM sequence: CTG
tctggtcctgttctcttcct

SEQ ID NO: 15281 - DNA, 20 bp, Artificial Sequence
  Description of Artificial Sequence: Synthetic oligonucleotide
  Target: AGXT; (-) strand; PAM type: YTN; PAM sequence: CTG
ctgtctggtcctgttctctt

SEQ ID NO: 15282 - DNA, 20 bp, Artificial Sequence
  Description of Artificial Sequence: Synthetic oligonucleotide
  Target: AGXT; (-) strand; PAM type: YTN; PAM sequence: CTG
tgccctgctgtctggtcctg

SEQ ID NO: 15283 - DNA, 20 bp, Artificial Sequence
  Description of Artificial Sequence: Synthetic oligonucleotide
  Target: AGXT; (-) strand; PAM type: YTN; PAM sequence: TTG
actgtgccctgctgtctggt

SEQ ID NO: 15284 - DNA, 20 bp, Artificial Sequence
  Description of Artificial Sequence: Synthetic oligonucleotide
  Target: AGXT; (-) strand; PAM type: YTN; PAM sequence: CTT
gactgtgccctgctgtctgg

SEQ ID NO: 15285 - DNA, 20 bp, Artificial Sequence
  Description of Artificial Sequence: Synthetic oligonucleotide
  Target: AGXT; (-) strand; PAM type: YTN; PAM sequence: CTG
cccttgactgtgccctgctg

SEQ ID NO: 15286 - DNA, 20 bp, Artificial Sequence
  Description of Artificial Sequence: Synthetic oligonucleotide
  Target: AGXT; (-) strand; PAM type: YTN; PAM sequence: CTC
tgcccttgactgtgccctgc

SEQ ID NO: 15287 - DNA, 20 bp, Artificial Sequence
  Description of Artificial Sequence: Synthetic oligonucleotide
  Target: AGXT; (-) strand; PAM type: YTN; PAM sequence: CTG
tgcctctgcccttgactgtg

SEQ ID NO: 15288 - DNA, 20 bp, Artificial Sequence
  Description of Artificial Sequence: Synthetic oligonucleotide
  Target: AGXT; (-) strand; PAM type: YTN; PAM sequence: CTG
ccaggtccctgtgcctctgc

SEQ ID NO: 15289 - DNA, 20 bp, Artificial Sequence
  Description of Artificial Sequence: Synthetic oligonucleotide
  Target: AGXT; (-) strand; PAM type: YTN; PAM sequence: CTC
tgccaggtccctgtgcctct

SEQ ID NO: 15290 - DNA, 20 bp, Artificial Sequence
  Description of Artificial Sequence: Synthetic oligonucleotide
  Target: AGXT; (-) strand; PAM type: YTN; PAM sequence: CTG
cactctgccaggtccctgtg

SEQ ID NO: 15291 - DNA, 20 bp, Artificial Sequence
  Description of Artificial Sequence: Synthetic oligonucleotide
  Target: AGXT; (-) strand; PAM type: YTN; PAM sequence: CTG
caatctgcactctgccaggt

SEQ ID NO: 15292 - DNA, 20 bp, Artificial Sequence
  Description of Artificial Sequence: Synthetic oligonucleotide
  Target: AGXT; (-) strand; PAM type: YTN; PAM sequence: CTG
cgcatgtgcccctgcaatct

SEQ ID NO: 15293 - DNA, 20 bp, Artificial Sequence
  Description of Artificial Sequence: Synthetic oligonucleotide
  Target: AGXT; (-) strand; PAM type: YTN; PAM sequence: CTC
tgcgcatgtgcccctgcaat

SEQ ID NO: 15294 - DNA, 20 bp, Artificial Sequence
  Description of Artificial Sequence: Synthetic oligonucleotide
  Target: AGXT; (-) strand; PAM type: YTN; PAM sequence: TTC
tctgcgcatgtgcccctgca

SEQ ID NO: 15295 - DNA, 20 bp, Artificial Sequence
  Description of Artificial Sequence: Synthetic oligonucleotide
  Target: AGXT; (-) strand; PAM type: YTN; PAM sequence: CTT
ctctgcgcatgtgcccctgc

SEQ ID NO: 15296 - DNA, 20 bp, Artificial Sequence
  Description of Artificial Sequence: Synthetic oligonucleotide
  Target: AGXT; (-) strand; PAM type: YTN; PAM sequence: CTG
gcccgtcttctctgcgcatg

SEQ ID NO: 15297 - DNA, 20 bp, Artificial Sequence
  Description of Artificial Sequence: Synthetic oligonucleotide
  Target: AGXT; (-) strand; PAM type: YTN; PAM sequence: CTG
gccctggcccgtcttctctg

SEQ ID NO: 15298 - DNA, 20 bp, Artificial Sequence
  Description of Artificial Sequence: Synthetic oligonucleotide
  Target: AGXT; (-) strand; PAM type: YTN; PAM sequence: CTC
tggccctggcccgtcttctc

SEQ ID NO: 15299 - DNA, 20 bp, Artificial Sequence
  Description of Artificial Sequence: Synthetic oligonucleotide
  Target: AGXT; (-) strand; PAM type: YTN; PAM sequence: CTA
ctctggccctggcccgtctt

SEQ ID NO: 15300 - DNA, 20 bp, Artificial Sequence
  Description of Artificial Sequence: Synthetic oligonucleotide
  Target: AGXT; (-) strand; PAM type: YTN; PAM sequence: CTC
tactctggccctggcccgtc

SEQ ID NO: 15301 - DNA, 20 bp, Artificial Sequence
  Description of Artificial Sequence: Synthetic oligonucleotide
  Target: AGXT; (-) strand; PAM type: YTN; PAM sequence: CTC
tctactctggccctggcccg

SEQ ID NO: 15302 - DNA, 20 bp, Artificial Sequence
  Description of Artificial Sequence: Synthetic oligonucleotide
  Target: AGXT; (-) strand; PAM type: YTN; PAM sequence: CTG
ctctctactctggccctggc

SEQ ID NO: 15303 - DNA, 20 bp, Artificial Sequence
  Description of Artificial Sequence: Synthetic oligonucleotide
  Target: AGXT; (-) strand; PAM type: YTN; PAM sequence: CTC
atggccaccccaggtgggtc

SEQ ID NO: 15304 - DNA, 20 bp, Artificial Sequence
  Description of Artificial Sequence: Synthetic oligonucleotide
  Target: AGXT; (-) strand; PAM type: YTN; PAM sequence: CTC
tcatggccaccccaggtggg

SEQ ID NO: 15305 - DNA, 20 bp, Artificial Sequence
  Description of Artificial Sequence: Synthetic oligonucleotide
  Target: AGXT; (-) strand; PAM type: YTN; PAM sequence: CTC
cagccaccagctctcatggc

SEQ ID NO: 15306 - DNA, 20 bp, Artificial Sequence
  Description of Artificial Sequence: Synthetic oligonucleotide
  Target: AGXT; (-) strand; PAM type: YTN; PAM sequence: CTC
ccggcctccagccaccagct

SEQ ID NO: 15307 - DNA, 20 bp, Artificial Sequence
  Description of Artificial Sequence: Synthetic oligonucleotide
  Target: AGXT; (-) strand; PAM type: YTN; PAM sequence: CTG
gtcacgggtcctcccggcct

SEQ ID NO: 15308 - DNA, 20 bp, Artificial Sequence
  Description of Artificial Sequence: Synthetic oligonucleotide
  Target: AGXT; (-) strand; PAM type: YTN; PAM sequence: CTC
tggtcacgggtcctcccggc

SEQ ID NO: 15309 - DNA, 20 bp, Artificial Sequence
  Description of Artificial Sequence: Synthetic oligonucleotide
  Target: AGXT; (-) strand; PAM type: YTN; PAM sequence: TTA
cctctggtcacgggtcctcc

SEQ ID NO: 15310 - DNA, 20 bp, Artificial Sequence
  Description of Artificial Sequence: Synthetic oligonucleotide
  Target: AGXT; (-) strand; PAM type: YTN; PAM sequence: CTC
agtgccattacctctggtca

SEQ ID NO: 15311 - DNA, 20 bp, Artificial Sequence
  Description of Artificial Sequence: Synthetic oligonucleotide
  Target: AGXT; (-) strand; PAM type: YTN; PAM sequence: CTG
ggcccctcagtgccattacc

SEQ ID NO: 15312 - DNA, 20 bp, Artificial Sequence
  Description of Artificial Sequence: Synthetic oligonucleotide
  Target: AGXT; (-) strand; PAM type: YTN; PAM sequence: CTC
cagccctgggcccctcagtg

SEQ ID NO: 15313 - DNA, 20 bp, Artificial Sequence
  Description of Artificial Sequence: Synthetic oligonucleotide
  Target: AGXT; (-) strand; PAM type: YTN; PAM sequence: CTC
tccagccctgggcccctcag

SEQ ID NO: 15314 - DNA, 20 bp, Artificial Sequence
  Description of Artificial Sequence: Synthetic oligonucleotide
  Target: AGXT; (-) strand; PAM type: YTN; PAM sequence: CTG
gacaggtgaggggtggtctc

SEQ ID NO: 15315 - DNA, 20 bp, Artificial Sequence
  Description of Artificial Sequence: Synthetic oligonucleotide
  Target: AGXT; (-) strand; PAM type: YTN; PAM sequence: CTC
tggacaggtgaggggtggtc

SEQ ID NO: 15316 - DNA, 20 bp, Artificial Sequence
  Description of Artificial Sequence: Synthetic oligonucleotide
  Target: AGXT; (-) strand; PAM type: YTN; PAM sequence: CTC
agctctggacaggtgagggg

SEQ ID NO: 15317 - DNA, 20 bp, Artificial Sequence
  Description of Artificial Sequence: Synthetic oligonucleotide
  Target: AGXT; (-) strand; PAM type: YTN; PAM sequence: CTG
cctcagctctggacaggtga

SEQ ID NO: 15318 - DNA, 20 bp, Artificial Sequence
  Description of Artificial Sequence: Synthetic oligonucleotide
  Target: AGXT; (-) strand; PAM type: YTN; PAM sequence: CTC
ctgcctcagctctggacagg

SEQ ID NO: 15319 - DNA, 20 bp, Artificial Sequence
  Description of Artificial Sequence: Synthetic oligonucleotide
  Target: AGXT; (-) strand; PAM type: YTN; PAM sequence: CTG
ctcctgcctcagctctggac

SEQ ID NO: 15320 - DNA, 20 bp, Artificial Sequence
  Description of Artificial Sequence: Synthetic oligonucleotide
  Target: AGXT; (-) strand; PAM type: YTN; PAM sequence: CTC
cgcagcactgctcctgcctc

SEQ ID NO: 15321 - DNA, 20 bp, Artificial Sequence
  Description of Artificial Sequence: Synthetic oligonucleotide
  Target: AGXT; (-) strand; PAM type: YTN; PAM sequence: CTG
gcatcctccgcagcactgct

SEQ ID NO: 15322 - DNA, 20 bp, Artificial Sequence
  Description of Artificial Sequence: Synthetic oligonucleotide
  Target: AGXT; (-) strand; PAM type: YTN; PAM sequence: CTC
ccccgacctggcatcctccg

SEQ ID NO: 15323 - DNA, 20 bp, Artificial Sequence
  Description of Artificial Sequence: Synthetic oligonucleotide
  Target: AGXT; (-) strand; PAM type: YTN; PAM sequence: CTC
agggccagctcccccgacct

SEQ ID NO: 15324 - DNA, 20 bp, Artificial Sequence
  Description of Artificial Sequence: Synthetic oligonucleotide
  Target: AGXT; (-) strand; PAM type: YTN; PAM sequence: CTC
tcagggccagctcccccgac

SEQ ID NO: 15325 - DNA, 20 bp, Artificial Sequence
  Description of Artificial Sequence: Synthetic oligonucleotide
  Target: AGXT; (-) strand; PAM type: YTN; PAM sequence: CTC
ctctcagggccagctccccc

SEQ ID NO: 15326 - DNA, 20 bp, Artificial Sequence
  Description of Artificial Sequence: Synthetic oligonucleotide
  Target: AGXT; (-) strand; PAM type: YTN; PAM sequence: CTC
tcctctcagggccagctccc

SEQ ID NO: 15327 - DNA, 20 bp, Artificial Sequence
  Description of Artificial Sequence: Synthetic oligonucleotide
  Target: AGXT; (-) strand; PAM type: YTN; PAM sequence: CTC
ccaggccccctctcctctca

SEQ ID NO: 15328 - DNA, 20 bp, Artificial Sequence
  Description of Artificial Sequence: Synthetic oligonucleotide
  Target: AGXT; (-) strand; PAM type: YTN; PAM sequence: CTG
gctcccaggccccctctcct

SEQ ID NO: 15329 - DNA, 20 bp, Artificial Sequence
  Description of Artificial Sequence: Synthetic oligonucleotide
  Target: AGXT; (-) strand; PAM type: YTN; PAM sequence: CTC
agggtgctggctcccaggcc

SEQ ID NO: 15330 - DNA, 20 bp, Artificial Sequence
  Description of Artificial Sequence: Synthetic oligonucleotide
  Target: AGXT; (-) strand; PAM type: YTN; PAM sequence: CTG
gagtggatcagggccagggc

SEQ ID NO: 15331 - DNA, 20 bp, Artificial Sequence
  Description of Artificial Sequence: Synthetic oligonucleotide
  Target: AGXT; (-) strand; PAM type: YTN; PAM sequence: CTA
cacagggctggagtggatca

SEQ ID NO: 15332 - DNA, 20 bp, Artificial Sequence
  Description of Artificial Sequence: Synthetic oligonucleotide
  Target: AGXT; (-) strand; PAM type: YTN; PAM sequence: TTG
ggctacacagggctggagtg

SEQ ID NO: 15333 - DNA, 20 bp, Artificial Sequence
  Description of Artificial Sequence: Synthetic oligonucleotide
  Target: AGXT; (-) strand; PAM type: YTN; PAM sequence: CTG
ttgggctacacagggctgga

SEQ ID NO: 15334 - DNA, 20 bp, Artificial Sequence
  Description of Artificial Sequence: Synthetic oligonucleotide
  Target: AGXT; (-) strand; PAM type: YTN; PAM sequence: CTG
ggcaaggaggggaagggctg

SEQ ID NO: 15335 - DNA, 20 bp, Artificial Sequence
  Description of Artificial Sequence: Synthetic oligonucleotide
  Target: AGXT; (-) strand; PAM type: YTN; PAM sequence: TTG
cagggggaggggactgggca

SEQ ID NO: 15336 - DNA, 20 bp, Artificial Sequence
  Description of Artificial Sequence: Synthetic oligonucleotide
  Target: AGXT; (-) strand; PAM type: YTN; PAM sequence: CTT
gcagggggaggggactgggc

SEQ ID NO: 15337 - DNA, 20 bp, Artificial Sequence
  Description of Artificial Sequence: Synthetic oligonucleotide
  Target: AGXT; (-) strand; PAM type: YTN; PAM sequence: CTG
ggggagaagagtggagagtg

SEQ ID NO: 15338 - DNA, 20 bp, Artificial Sequence
  Description of Artificial Sequence: Synthetic oligonucleotide
  Target: AGXT; (-) strand; PAM type: YTN; PAM sequence: CTG
tggcccctgggggagaagag

SEQ ID NO: 15339 - DNA, 20 bp, Artificial Sequence
  Description of Artificial Sequence: Synthetic oligonucleotide
  Target: AGXT; (-) strand; PAM type: YTN; PAM sequence: CTG
cctgtggcccctgggggaga

SEQ ID NO: 15340 - DNA, 20 bp, Artificial Sequence
  Description of Artificial Sequence: Synthetic oligonucleotide
  Target: AGXT; (-) strand; PAM type: YTN; PAM sequence: TTC
agagagacagaggggaggtc

SEQ ID NO: 15341 - DNA, 20 bp, Artificial Sequence
  Description of Artificial Sequence: Synthetic oligonucleotide
  Target: AGXT; (-) strand; PAM type: YTN; PAM sequence: CTG
ggagagacagaggagggttc

SEQ ID NO: 15342 - DNA, 20 bp, Artificial Sequence
  Description of Artificial Sequence: Synthetic oligonucleotide
  Target: AGXT; (-) strand; PAM type: YTN; PAM sequence: CTG
ggtctgggagagacagagga

SEQ ID NO: 15343 - DNA, 20 bp, Artificial Sequence
  Description of Artificial Sequence: Synthetic oligonucleotide
  Target: AGXT; (-) strand; PAM type: YTN; PAM sequence: CTA
ccccagggcagaaggaaaca

SEQ ID NO: 15344 - DNA, 20 bp, Artificial Sequence
  Description of Artificial Sequence: Synthetic oligonucleotide
  Target: AGXT; (-) strand; PAM type: YTN; PAM sequence: CTG
ggactaccccagggcagaag

SEQ ID NO: 15345 - DNA, 20 bp, Artificial Sequence
  Description of Artificial Sequence: Synthetic oligonucleotide
  Target: AGXT; (-) strand; PAM type: YTN; PAM sequence: CTG
gggcagggcctgggactacc

SEQ ID NO: 15346 - DNA, 20 bp, Artificial Sequence
  Description of Artificial Sequence: Synthetic oligonucleotide
  Target: AGXT; (-) strand; PAM type: YTN; PAM sequence: TTG
cctggggcagggcctgggac

SEQ ID NO: 15347 - DNA, 20 bp, Artificial Sequence
  Description of Artificial Sequence: Synthetic oligonucleotide
  Target: AGXT; (-) strand; PAM type: YTN; PAM sequence: TTT
gcctggggcagggcctggga

SEQ ID NO: 15348 - DNA, 20 bp, Artificial Sequence
  Description of Artificial Sequence: Synthetic oligonucleotide
  Target: AGXT; (-) strand; PAM type: YTN; PAM sequence: CTT
tgcctggggcagggcctggg

SEQ ID NO: 15349 - DNA, 20 bp, Artificial Sequence
  Description of Artificial Sequence: Synthetic oligonucleotide
  Target: AGXT; (-) strand; PAM type: YTN; PAM sequence: TTG
actttgcctggggcagggcc

SEQ ID NO: 15350 - DNA, 20 bp, Artificial Sequence
  Description of Artificial Sequence: Synthetic oligonucleotide
  Target: AGXT; (-) strand; PAM type: YTN; PAM sequence: TTT
gactttgcctggggcagggc

SEQ ID NO: 15351 - DNA, 20 bp, Artificial Sequence
  Description of Artificial Sequence: Synthetic oligonucleotide
  Target: AGXT; (-) strand; PAM type: YTN; PAM sequence: CTG
gagcccccagtttgactttg

SEQ ID NO: 15352 - DNA, 20 bp, Artificial Sequence
  Description of Artificial Sequence: Synthetic oligonucleotide
  Target: AGXT; (-) strand; PAM type: YTN; PAM sequence: TTG
gtgcaggggagcccctggag

SEQ ID NO: 15353 - DNA, 20 bp, Artificial Sequence
  Description of Artificial Sequence: Synthetic oligonucleotide
  Target: AGXT; (-) strand; PAM type: YTN; PAM sequence: CTT
ggtgcaggggagcccctgga

SEQ ID NO: 15354 - DNA, 20 bp, Artificial Sequence
  Description of Artificial Sequence: Synthetic oligonucleotide
  Target: AGXT; (-) strand; PAM type: YTN; PAM sequence: CTG
caggccttggtgcaggggag

SEQ ID NO: 15355 - DNA, 20 bp, Artificial Sequence
  Description of Artificial Sequence: Synthetic oligonucleotide
  Target: AGXT; (-) strand; PAM type: YTN; PAM sequence: CTC
tgcaggccttggtgcagggg

SEQ ID NO: 15356 - DNA, 20 bp, Artificial Sequence
  Description of Artificial Sequence: Synthetic oligonucleotide
  Target: AGXT; (-) strand; PAM type: YTN; PAM sequence: CTG
actctgcaggccttggtgca

SEQ ID NO: 15357 - DNA, 20 bp, Artificial Sequence
  Description of Artificial Sequence: Synthetic oligonucleotide
  Target: AGXT; (-) strand; PAM type: YTN; PAM sequence: CTG
tggtgcgggaggaagaacct

SEQ ID NO: 15358 - DNA, 20 bp, Artificial Sequence
  Description of Artificial Sequence: Synthetic oligonucleotide
  Target: AGXT; (-) strand; PAM type: YTN; PAM sequence: CTC
tgtggtgcgggaggaagaac

SEQ ID NO: 15359 - DNA, 20 bp, Artificial Sequence
  Description of Artificial Sequence: Synthetic oligonucleotide
  Target: AGXT; (-) strand; PAM type: YTN; PAM sequence: CTG
gtgggcagtgacatgggtgg

SEQ ID NO: 15360 - DNA, 20 bp, Artificial Sequence
  Description of Artificial Sequence: Synthetic oligonucleotide
  Target: AGXT; (-) strand; PAM type: YTN; PAM sequence: CTG
tgtgggagatggcgctggtg

SEQ ID NO: 15361 - DNA, 20 bp, Artificial Sequence
  Description of Artificial Sequence: Synthetic oligonucleotide
  Target: AGXT; (-) strand; PAM type: YTN; PAM sequence: CTC
caggccctgtgtgggagatg

SEQ ID NO: 15362 - DNA, 20 bp, Artificial Sequence
  Description of Artificial Sequence: Synthetic oligonucleotide
  Target: AGXT; (-) strand; PAM type: YTN; PAM sequence: TTC
tccaggccctgtgtgggaga

SEQ ID NO: 15363 - DNA, 20 bp, Artificial Sequence
  Description of Artificial Sequence: Synthetic oligonucleotide
  Target: AGXT; (-) strand; PAM type: YTN; PAM sequence: CTG
ttctccaggccctgtgtggg

SEQ ID NO: 15364 - DNA, 20 bp, Artificial Sequence
  Description of Artificial Sequence: Synthetic oligonucleotide
  Target: AGXT; (-) strand; PAM type: YTN; PAM sequence: CTG
gcgccagctgttctccaggc

SEQ ID NO: 15365 - DNA, 20 bp, Artificial Sequence
  Description of Artificial Sequence: Synthetic oligonucleotide
  Target: AGXT; (-) strand; PAM type: YTN; PAM sequence: CTC
gcggtgctggcgccagctgt

SEQ ID NO: 15366 - DNA, 20 bp, Artificial Sequence
  Description of Artificial Sequence: Synthetic oligonucleotide
  Target: AGXT; (-) strand; PAM type: YTN; PAM sequence: CTG
caggcgcccatgcagatacg

SEQ ID NO: 15367 - DNA, 20 bp, Artificial Sequence
  Description of Artificial Sequence: Synthetic oligonucleotide
  Target: AGXT; (-) strand; PAM type: YTN; PAM sequence: CTG
cagccccagtgcctgcaggc

SEQ ID NO: 15368 - DNA, 20 bp, Artificial Sequence
  Description of Artificial Sequence: Synthetic oligonucleotide
  Target: AGXT; (-) strand; PAM type: YTN; PAM sequence: TTC
acgaagagctgcagccccag

SEQ ID NO: 15369 - DNA, 20 bp, Artificial Sequence
  Description of Artificial Sequence: Synthetic oligonucleotide
  Target: AGXT; (-) strand; PAM type: YTN; PAM sequence: CTT
cacgaagagctgcagcccca

SEQ ID NO: 15370 - DNA, 20 bp, Artificial Sequence
  Description of Artificial Sequence: Synthetic oligonucleotide
  Target: AGXT; (-) strand; PAM type: YTN; PAM sequence: TTA
ccgggtccttcacgaagagc

SEQ ID NO: 15371 - DNA, 20 bp, Artificial Sequence
  Description of Artificial Sequence: Synthetic oligonucleotide
  Target: AGXT; (-) strand; PAM type: YTN; PAM sequence: CTT
accgggtccttcacgaagag

SEQ ID NO: 15372 - DNA, 20 bp, Artificial Sequence
  Description of Artificial Sequence: Synthetic oligonucleotide
  Target: AGXT; (-) strand; PAM type: YTN; PAM sequence: CTC
cttaccgggtccttcacgaa

SEQ ID NO: 15373 - DNA, 20 bp, Artificial Sequence
  Description of Artificial Sequence: Synthetic oligonucleotide
  Target: AGXT; (-) strand; PAM type: YTN; PAM sequence: CTG
cccaatgccaggggcctcct

SEQ ID NO: 15374 - DNA, 20 bp, Artificial Sequence
  Description of Artificial Sequence: Synthetic oligonucleotide
  Target: AGXT; (-) strand; PAM type: YTN; PAM sequence: TTC
cccatgggtgcagggctgcc

SEQ ID NO: 15375 - DNA, 20 bp, Artificial Sequence
  Description of Artificial Sequence: Synthetic oligonucleotide
  Target: AGXT; (-) strand; PAM type: YTN; PAM sequence: CTT
ccccatgggtgcagggctgc

SEQ ID NO: 15376 - DNA, 20 bp, Artificial Sequence
  Description of Artificial Sequence: Synthetic oligonucleotide
  Target: AGXT; (-) strand; PAM type: YTN; PAM sequence: CTC
atccttccccatgggtgcag

SEQ ID NO: 15377 - DNA, 20 bp, Artificial Sequence
  Description of Artificial Sequence: Synthetic oligonucleotide
  Target: AGXT; (-) strand; PAM type: YTN; PAM sequence: CTG
ggcaagagcccctcatcctt

SEQ ID NO: 15378 - DNA, 20 bp, Artificial Sequence
  Description of Artificial Sequence: Synthetic oligonucleotide
  Target: AGXT; (-) strand; PAM type: YTN; PAM sequence: TTG
agggggctgggcaagagccc

SEQ ID NO: 15379 - DNA, 20 bp, Artificial Sequence
  Description of Artificial Sequence: Synthetic oligonucleotide
  Target: AGXT; (-) strand; PAM type: YTN; PAM sequence: CTT
gagggggctgggcaagagcc

SEQ ID NO: 15380 - DNA, 20 bp, Artificial Sequence
  Description of Artificial Sequence: Synthetic oligonucleotide
  Target: AGXT; (-) strand; PAM type: YTN; PAM sequence: CTC
ttgagggggctgggcaagag

SEQ ID NO: 15381 - DNA, 20 bp, Artificial Sequence
  Description of Artificial Sequence: Synthetic oligonucleotide
  Target: AGXT; (-) strand; PAM type: YTN; PAM sequence: CTC
aggagccagtgtccctcttg

SEQ ID NO: 15382 - DNA, 20 bp, Artificial Sequence
  Description of Artificial Sequence: Synthetic oligonucleotide
  Target: AGXT; (-) strand; PAM type: YTN; PAM sequence: TTC
tcaggagccagtgtccctct

SEQ ID NO: 15383 - DNA, 20 bp, Artificial Sequence
  Description of Artificial Sequence: Synthetic oligonucleotide
  Target: AGXT; (-) strand; PAM type: YTN; PAM sequence: CTT
ctcaggagccagtgtccctc

SEQ ID NO: 15384 - DNA, 20 bp, Artificial Sequence
  Description of Artificial Sequence: Synthetic oligonucleotide
  Target: AGXT; (-) strand; PAM type: YTN; PAM sequence: CTC
cttctcaggagccagtgtcc

SEQ ID NO: 15385 - DNA, 20 bp, Artificial Sequence
  Description of Artificial Sequence: Synthetic oligonucleotide
  Target: AGXT; (-) strand; PAM type: YTN; PAM sequence: CTG
gcaccgaggccacaccaccg

SEQ ID NO: 15386 - DNA, 20 bp, Artificial Sequence
  Description of Artificial Sequence: Synthetic oligonucleotide
  Target: AGXT; (-) strand; PAM type: YTN; PAM sequence: CTA
atccctggcaccgaggccac

SEQ ID NO: 15387 - DNA, 20 bp, Artificial Sequence
  Description of Artificial Sequence: Synthetic oligonucleotide
  Target: AGXT; (-) strand; PAM type: YTN; PAM sequence: CTG
ccgagactaatccctggcac

SEQ ID NO: 15388 - DNA, 20 bp, Artificial Sequence
  Description of Artificial Sequence: Synthetic oligonucleotide
  Target: AGXT; (-) strand; PAM type: YTN; PAM sequence: CTC
ctgccgagactaatccctgg

SEQ ID NO: 15389 - DNA, 20 bp, Artificial Sequence
  Description of Artificial Sequence: Synthetic oligonucleotide
  Target: AGXT; (-) strand; PAM type: YTN; PAM sequence: TTC
gtggctcctgccgagactaa

SEQ ID NO: 15390 - DNA, 20 bp, Artificial Sequence
  Description of Artificial Sequence: Synthetic oligonucleotide
  Target: AGXT; (-) strand; PAM type: YTN; PAM sequence: CTT
cgtggctcctgccgagacta

SEQ ID NO: 15391 - DNA, 20 bp, Artificial Sequence
  Description of Artificial Sequence: Synthetic oligonucleotide
  Target: AGXT; (-) strand; PAM type: YTN; PAM sequence: CTG
tgacttcgtggctcctgccg

SEQ ID NO: 15392 - DNA, 20 bp, Artificial Sequence
  Description of Artificial Sequence: Synthetic oligonucleotide
  Target: AGXT; (-) strand; PAM type: YTN; PAM sequence: CTG
agatcccgcatcagaggccg

SEQ ID NO: 15393 - DNA, 20 bp, Artificial Sequence
  Description of Artificial Sequence: Synthetic oligonucleotide
  Target: AGXT; (-) strand; PAM type: YTN; PAM sequence: CTG
ggagatcacaggccgtcctg

SEQ ID NO: 15394 - DNA, 20 bp, Artificial Sequence
  Description of Artificial Sequence: Synthetic oligonucleotide
  Target: AGXT; (-) strand; PAM type: YTN; PAM sequence: TTC
ccactgggagatcacaggcc

SEQ ID NO: 15395 - DNA, 20 bp, Artificial Sequence
  Description of Artificial Sequence: Synthetic oligonucleotide
  Target: AGXT; (-) strand; PAM type: YTN; PAM sequence: CTT
cccactgggagatcacaggc

SEQ ID NO: 15396 - DNA, 20 bp, Artificial Sequence
  Description of Artificial Sequence: Synthetic oligonucleotide
  Target: AGXT; (-) strand; PAM type: YTN; PAM sequence: TTA
ggaggcggtggatgggcacc

SEQ ID NO: 15397 - DNA, 20 bp, Artificial Sequence
  Description of Artificial Sequence: Synthetic oligonucleotide
  Target: AGXT; (-) strand; PAM type: YTN; PAM sequence: CTT
aggaggcggtggatgggcac

SEQ ID NO: 15398 - DNA, 20 bp, Artificial Sequence
  Description of Artificial Sequence: Synthetic oligonucleotide
  Target: AGXT; (-) strand; PAM type: YTN; PAM sequence: TTC
cagaggagccgggggagaaa

SEQ ID NO: 15399 - DNA, 20 bp, Artificial Sequence
  Description of Artificial Sequence: Synthetic oligonucleotide
  Target: AGXT; (-) strand; PAM type: YTN; PAM sequence: TTC
aggttccagaggagccgggg

SEQ ID NO: 15400 - DNA, 20 bp, Artificial Sequence
  Description of Artificial Sequence: Synthetic oligonucleotide
  Target: AGXT; (-) strand; PAM type: YTN; PAM sequence: CTT
caggttccagaggagccggg

SEQ ID NO: 15401 - DNA, 20 bp, Artificial Sequence
  Description of Artificial Sequence: Synthetic oligonucleotide
  Target: AGXT; (-) strand; PAM type: YTN; PAM sequence: CTG
ccccagcttcaggttccaga

SEQ ID NO: 15402 - DNA, 20 bp, Artificial Sequence
  Description of Artificial Sequence: Synthetic oligonucleotide
  Target: AGXT; (-) strand; PAM type: YTN; PAM sequence: CTG
caccatctgccccagcttca

SEQ ID NO: 15403 - DNA, 20 bp, Artificial Sequence
  Description of Artificial Sequence: Synthetic oligonucleotide
  Target: AGXT; (-) strand; PAM type: YTN; PAM sequence: TTG
gcctgcaccatctgccccag

SEQ ID NO: 15404 - DNA, 20 bp, Artificial Sequence
  Description of Artificial Sequence: Synthetic oligonucleotide
  Target: AGXT; (-) strand; PAM type: YTN; PAM sequence: CTT
ggcctgcaccatctgcccca

SEQ ID NO: 15405 - DNA, 20 bp, Artificial Sequence
  Description of Artificial Sequence: Synthetic oligonucleotide
  Target: AGXT; (-) strand; PAM type: YTN; PAM sequence: CTC
ttggcctgcaccatctgccc

SEQ ID NO: 15406 - DNA, 20 bp, Artificial Sequence
  Description of Artificial Sequence: Synthetic oligonucleotide
  Target: AGXT; (-) strand; PAM type: YTN; PAM sequence: TTG
tgacagctcttggcctgcac

SEQ ID NO: 15407 - DNA, 20 bp, Artificial Sequence
  Description of Artificial Sequence: Synthetic oligonucleotide
  Target: AGXT; (-) strand; PAM type: YTN; PAM sequence: TTT
gtgacagctcttggcctgca

SEQ ID NO: 15408 - DNA, 20 bp, Artificial Sequence
  Description of Artificial Sequence: Synthetic oligonucleotide
  Target: AGXT; (-) strand; PAM type: YTN; PAM sequence: CTT
tgtgacagctcttggcctgc

SEQ ID NO: 15409 - DNA, 20 bp, Artificial Sequence
  Description of Artificial Sequence: Synthetic oligonucleotide
  Target: AGXT; (-) strand; PAM type: YTN; PAM sequence: CTG
tacgggcctttgtgacagct

SEQ ID NO: 15410 - DNA, 20 bp, Artificial Sequence
  Description of Artificial Sequence: Synthetic oligonucleotide
  Target: AGXT; (-) strand; PAM type: YTN; PAM sequence: CTC
agtgcgtgggtgagaggccc

SEQ ID NO: 15411 - DNA, 20 bp, Artificial Sequence
  Description of Artificial Sequence: Synthetic oligonucleotide
  Target: AGXT; (-) strand; PAM type: YTN; PAM sequence: CTG
gctcagtgcgtgggtgagag

SEQ ID NO: 15412 - DNA, 20 bp, Artificial Sequence
  Description of Artificial Sequence: Synthetic oligonucleotide
  Target: AGXT; (-) strand; PAM type: YTN; PAM sequence: CTG
caggaggggcctggctcagt

SEQ ID NO: 15413 - DNA, 20 bp, Artificial Sequence
  Description of Artificial Sequence: Synthetic oligonucleotide
  Target: AGXT; (-) strand; PAM type: YTN; PAM sequence: CTG
tgggaagccggagcgcctgc

SEQ ID NO: 15414 - DNA, 20 bp, Artificial Sequence
  Description of Artificial Sequence: Synthetic oligonucleotide
  Target: AGXT; (-) strand; PAM type: YTN; PAM sequence: CTC
cagtcatagccagcgggtac

SEQ ID NO: 15415 - DNA, 20 bp, Artificial Sequence
  Description of Artificial Sequence: Synthetic oligonucleotide
  Target: AGXT; (-) strand; PAM type: YTN; PAM sequence: CTC
tccagtcatagccagcgggt

SEQ ID NO: 15416 - DNA, 20 bp, Artificial Sequence
  Description of Artificial Sequence: Synthetic oligonucleotide
  Target: AGXT; (-) strand; PAM type: YTN; PAM sequence: CTG
acgatgtctctccagtcata

SEQ ID NO: 15417 - DNA, 20 bp, Artificial Sequence
  Description of Artificial Sequence: Synthetic oligonucleotide
  Target: AGXT; (-) strand; PAM type: YTN; PAM sequence: CTA
tgacgtagctgacgatgtct

SEQ ID NO: 15418 - DNA, 20 bp, Artificial Sequence
  Description of Artificial Sequence: Synthetic oligonucleotide
  Target: AGXT; (-) strand; PAM type: YTN; PAM sequence: CTC
aatgtcgaagtggtctatga

SEQ ID NO: 15419 - DNA, 20 bp, Artificial Sequence
  Description of Artificial Sequence: Synthetic oligonucleotide
  Target: AGXT; (-) strand; PAM type: YTN; PAM sequence: TTC
cccgtggagggcccaaggcc

SEQ ID NO: 15420 - DNA, 20 bp, Artificial Sequence
  Description of Artificial Sequence: Synthetic oligonucleotide
  Target: AGXT; (-) strand; PAM type: YTN; PAM sequence: CTT
ccccgtggagggcccaaggc

SEQ ID NO: 15421 - DNA, 20 bp, Artificial Sequence
  Description of Artificial Sequence: Synthetic oligonucleotide
  Target: AGXT; (-) strand; PAM type: YTN; PAM sequence: CTC
accttccccgtggagggccc

SEQ ID NO: 15422 - DNA, 20 bp, Artificial Sequence
  Description of Artificial Sequence: Synthetic oligonucleotide
  Target: AGXT; (-) strand; PAM type: YTN; PAM sequence: CTC
tcaccttccccgtggagggc

SEQ ID NO: 15423 - DNA, 20 bp, Artificial Sequence
  Description of Artificial Sequence: Synthetic oligonucleotide
  Target: AGXT; (-) strand; PAM type: YTN; PAM sequence: CTC
cctctcaccttccccgtgga

SEQ ID NO: 15424 - DNA, 20 bp, Artificial Sequence
  Description of Artificial Sequence: Synthetic oligonucleotide
  Target: AGXT; (-) strand; PAM type: YTN; PAM sequence: CTC
gaggcgctccctctcacctt

SEQ ID NO: 15425 - DNA, 20 bp, Artificial Sequence
  Description of Artificial Sequence: Synthetic oligonucleotide
  Target: AGXT; (-) strand; PAM type: YTN; PAM sequence: CTG
caaaaggccctcgaggcgct

SEQ ID NO: 15426 - DNA, 20 bp, Artificial Sequence
  Description of Artificial Sequence: Synthetic oligonucleotide
  Target: AGXT; (-) strand; PAM type: YTN; PAM sequence: TTC
tgcaaaaggccctcgaggcg

SEQ ID NO: 15427 - DNA, 20 bp, Artificial Sequence
  Description of Artificial Sequence: Synthetic oligonucleotide
  Target: AGXT; (-) strand; PAM type: YTN; PAM sequence: TTT
ctgcaaaaggccctcgaggc

SEQ ID NO: 15428 - DNA, 20 bp, Artificial Sequence
  Description of Artificial Sequence: Synthetic oligonucleotide
  Target: AGXT; (-) strand; PAM type: YTN; PAM sequence: TTG
gtttctgcaaaaggccctcg

SEQ ID NO: 15429 - DNA, 20 bp, Artificial Sequence
  Description of Artificial Sequence: Synthetic oligonucleotide
  Target: AGXT; (-) strand; PAM type: YTN; PAM sequence: TTT
ggtttctgcaaaaggccctc

SEQ ID NO: 15430 - DNA, 20 bp, Artificial Sequence
  Description of Artificial Sequence: Synthetic oligonucleotide
  Target: AGXT; (-) strand; PAM type: YTN; PAM sequence: CTC
aaggaggggtggcgggtttg

SEQ ID NO: 15431 - DNA, 20 bp, Artificial Sequence
  Description of Artificial Sequence: Synthetic oligonucleotide
  Target: AGXT; (-) strand; PAM type: YTN; PAM sequence: CTG
ctcaaggaggggtggcgggt

SEQ ID NO: 15432 - DNA, 20 bp, Artificial Sequence
  Description of Artificial Sequence: Synthetic oligonucleotide
  Target: AGXT; (-) strand; PAM type: YTN; PAM sequence: CTG
gtgcacagtcctgctcaagg

SEQ ID NO: 15433 - DNA, 20 bp, Artificial Sequence
  Description of Artificial Sequence: Synthetic oligonucleotide
  Target: AGXT; (-) strand; PAM type: YTN; PAM sequence: CTG
cacctggtgcacagtcctgc

SEQ ID NO: 15434 - DNA, 20 bp, Artificial Sequence
  Description of Artificial Sequence: Synthetic oligonucleotide
  Target: AGXT; (-) strand; PAM type: YTN; PAM sequence: CTC
ccctgcacctggtgcacagt

SEQ ID NO: 15435 - DNA, 20 bp, Artificial Sequence
  Description of Artificial Sequence: Synthetic oligonucleotide
  Target: AGXT; (-) strand; PAM type: YTN; PAM sequence: TTC
ggatgaccccggcctcccct

SEQ ID NO: 15436 - DNA, 20 bp, Artificial Sequence
  Description of Artificial Sequence: Synthetic oligonucleotide
  Target: AGXT; (-) strand; PAM type: YTN; PAM sequence: TTT
cggatgaccccggcctcccc

SEQ ID NO: 15437 - DNA, 20 bp, Artificial Sequence
  Description of Artificial Sequence: Synthetic oligonucleotide
  Target: AGXT; (-) strand; PAM type: YTN; PAM sequence: CTT
tcggatgaccccggcctccc

SEQ ID NO: 15438 - DNA, 20 bp, Artificial Sequence
  Description of Artificial Sequence: Synthetic oligonucleotide
  Target: AGXT; (-) strand; PAM type: YTN; PAM sequence: CTG
ggctttcggatgaccccggc

SEQ ID NO: 15439 - DNA, 20 bp, Artificial Sequence
  Description of Artificial Sequence: Synthetic oligonucleotide
  Target: AGXT; (-) strand; PAM type: YTN; PAM sequence: CTG
caatctgggctttcggatga

SEQ ID NO: 15440 - DNA, 20 bp, Artificial Sequence
  Description of Artificial Sequence: Synthetic oligonucleotide
  Target: AGXT; (-) strand; PAM type: YTN; PAM sequence: CTC
ctgcaatctgggctttcgga

SEQ ID NO: 15441 - DNA, 20 bp, Artificial Sequence
  Description of Artificial Sequence: Synthetic oligonucleotide
  Target: AGXT; (-) strand; PAM type: YTN; PAM sequence: CTG
gacgctcctgcaatctgggc

SEQ ID NO: 15442 - DNA, 20 bp, Artificial Sequence
  Description of Artificial Sequence: Synthetic oligonucleotide
  Target: AGXT; (-) strand; PAM type: YTN; PAM sequence: TTC
tggacgctcctgcaatctgg

SEQ ID NO: 15443 - DNA, 20 bp, Artificial Sequence
  Description of Artificial Sequence: Synthetic oligonucleotide
  Target: AGXT; (-) strand; PAM type: YTN; PAM sequence: CTT
ctggacgctcctgcaatctg

SEQ ID NO: 15444 - DNA, 20 bp, Artificial Sequence
  Description of Artificial Sequence: Synthetic oligonucleotide
  Target: AGXT; (-) strand; PAM type: YTN; PAM sequence: TTG
gagagtgggcccttctggac

SEQ ID NO: 15445 - DNA, 20 bp, Artificial Sequence
  Description of Artificial Sequence: Synthetic oligonucleotide
  Target: AGXT; (-) strand; PAM type: YTN; PAM sequence: CTT
ggagagtgggcccttctgga

SEQ ID NO: 15446 - DNA, 20 bp, Artificial Sequence
  Description of Artificial Sequence: Synthetic oligonucleotide
  Target: AGXT; (-) strand; PAM type: YTN; PAM sequence: CTG
gataccccttggagagtggg

SEQ ID NO: 15447 - DNA, 20 bp, Artificial Sequence
  Description of Artificial Sequence: Synthetic oligonucleotide
  Target: AGXT; (-) strand; PAM type: YTN; PAM sequence: TTA
ctggataccccttggagagt

SEQ ID NO: 15448 - DNA, 20 bp, Artificial Sequence
  Description of Artificial Sequence: Synthetic oligonucleotide
  Target: AGXT; (-) strand; PAM type: YTN; PAM sequence: TTT
actggataccccttggagag

SEQ ID NO: 15449 - DNA, 20 bp, Artificial Sequence
  Description of Artificial Sequence: Synthetic oligonucleotide
  Target: AGXT; (-) strand; PAM type: YTN; PAM sequence: CTT
tactggataccccttggaga

SEQ ID NO: 15450 - DNA, 20 bp, Artificial Sequence
  Description of Artificial Sequence: Synthetic oligonucleotide
  Target: AGXT; (-) strand; PAM type: YTN; PAM sequence: CTG
gggtgggagcaggggcgaca

SEQ ID NO: 15451 - DNA, 20 bp, Artificial Sequence
  Description of Artificial Sequence: Synthetic oligonucleotide
  Target: AGXT; (-) strand; PAM type: YTN; PAM sequence: CTC
agtgggctggggtgggagca

SEQ ID NO: 15452 - DNA, 20 bp, Artificial Sequence
  Description of Artificial Sequence: Synthetic oligonucleotide
  Target: AGXT; (-) strand; PAM type: YTN; PAM sequence: CTG
gtgacctcagtgggctgggg

SEQ ID NO: 15453 - DNA, 20 bp, Artificial Sequence
  Description of Artificial Sequence: Synthetic oligonucleotide
  Target: AGXT; (-) strand; PAM type: YTN; PAM sequence: CTG
cacctggtgacctcagtggg

SEQ ID NO: 15454 - DNA, 20 bp, Artificial Sequence
  Description of Artificial Sequence: Synthetic oligonucleotide
  Target: AGXT; (-) strand; PAM type: YTN; PAM sequence: TTC
cgagtggaatcataaaggct

SEQ ID NO: 15455 - DNA, 20 bp, Artificial Sequence
  Description of Artificial Sequence: Synthetic oligonucleotide
  Target: AGXT; (-) strand; PAM type: YTN; PAM sequence: CTG
gtcagagggaaggaaggatg

SEQ ID NO: 15456 - DNA, 20 bp, Artificial Sequence
  Description of Artificial Sequence: Synthetic oligonucleotide
  Target: AGXT; (-) strand; PAM type: YTN; PAM sequence: TTC
cagggtctggtcagagggaa

SEQ ID NO: 15457 - DNA, 20 bp, Artificial Sequence
  Description of Artificial Sequence: Synthetic oligonucleotide
  Target: AGXT; (-) strand; PAM type: YTN; PAM sequence: CTG
gttccagggtctggtcagag

SEQ ID NO: 15458 - DNA, 20 bp, Artificial Sequence
  Description of Artificial Sequence: Synthetic oligonucleotide
  Target: AGXT; (-) strand; PAM type: YTN; PAM sequence: TTC
cggcctggttccagggtctg

SEQ ID NO: 15459 - DNA, 20 bp, Artificial Sequence
  Description of Artificial Sequence: Synthetic oligonucleotide
  Target: AGXT; (-) strand; PAM type: YTN; PAM sequence: CTT
ccggcctggttccagggtct

SEQ ID NO: 15460 - DNA, 20 bp, Artificial Sequence
  Description of Artificial Sequence: Synthetic oligonucleotide
  Target: AGXT; (-) strand; PAM type: YTN; PAM sequence: CTC
agagacacagccaggcccag

SEQ ID NO: 15461 - DNA, 20 bp, Artificial Sequence
  Description of Artificial Sequence: Synthetic oligonucleotide
  Target: AGXT; (-) strand; PAM type: YTN; PAM sequence: CTG
ccactcagagacacagccag

SEQ ID NO: 15462 - DNA, 20 bp, Artificial Sequence
  Description of Artificial Sequence: Synthetic oligonucleotide
  Target: AGXT; (-) strand; PAM type: YTN; PAM sequence: CTC
cccactgccactcagagaca

SEQ ID NO: 15463 - DNA, 20 bp, Artificial Sequence
  Description of Artificial Sequence: Synthetic oligonucleotide
  Target: AGXT; (-) strand; PAM type: YTN; PAM sequence: CTG
cacccgcagccacacgggag

SEQ ID NO: 15464 - DNA, 20 bp, Artificial Sequence
  Description of Artificial Sequence: Synthetic oligonucleotide
  Target: AGXT; (-) strand; PAM type: YTN; PAM sequence: CTC
tgcacccgcagccacacggg

SEQ ID NO: 15465 - DNA, 20 bp, Artificial Sequence
  Description of Artificial Sequence: Synthetic oligonucleotide
  Target: AGXT; (-) strand; PAM type: YTN; PAM sequence: CTC
cctctgcacccgcagccaca

SEQ ID NO: 15466 - DNA, 20 bp, Artificial Sequence
  Description of Artificial Sequence: Synthetic oligonucleotide
  Target: AGXT; (-) strand; PAM type: YTN; PAM sequence: CTC
ctccctctgcacccgcagcc

SEQ ID NO: 15467 - DNA, 20 bp, Artificial Sequence
  Description of Artificial Sequence: Synthetic oligonucleotide
  Target: AGXT; (-) strand; PAM type: YTN; PAM sequence: CTC
tcctccctctgcacccgcag

SEQ ID NO: 15468 - DNA, 20 bp, Artificial Sequence
  Description of Artificial Sequence: Synthetic oligonucleotide
  Target: AGXT; (-) strand; PAM type: YTN; PAM sequence: TTG
agcacccaggccagggcagg

SEQ ID NO: 15469 - DNA, 20 bp, Artificial Sequence
  Description of Artificial Sequence: Synthetic oligonucleotide
  Target: AGXT; (-) strand; PAM type: YTN; PAM sequence: CTT
gagcacccaggccagggcag

SEQ ID NO: 15470 - DNA, 20 bp, Artificial Sequence
  Description of Artificial Sequence: Synthetic oligonucleotide
  Target: AGXT; (-) strand; PAM type: YTN; PAM sequence: CTG
tgcaggtcacagagggggcc

SEQ ID NO: 15471 - DNA, 20 bp, Artificial Sequence
  Description of Artificial Sequence: Synthetic oligonucleotide
  Target: AGXT; (-) strand; PAM type: YTN; PAM sequence: TTG
acagccctgtgcaggtcaca

SEQ ID NO: 15472 - DNA, 20 bp, Artificial Sequence
  Description of Artificial Sequence: Synthetic oligonucleotide
  Target: AGXT; (-) strand; PAM type: YTN; PAM sequence: CTG
agtgaggaccacccacccag

SEQ ID NO: 15473 - DNA, 20 bp, Artificial Sequence
  Description of Artificial Sequence: Synthetic oligonucleotide
  Target: AGXT; (-) strand; PAM type: YTN; PAM sequence: CTC
acctgagtgaggaccaccca

SEQ ID NO: 15474 - DNA, 20 bp, Artificial Sequence
  Description of Artificial Sequence: Synthetic oligonucleotide
  Target: AGXT; (-) strand; PAM type: YTN; PAM sequence: CTG
gccagagccaggatgggctc

SEQ ID NO: 15475 - DNA, 20 bp, Artificial Sequence
  Description of Artificial Sequence: Synthetic oligonucleotide
  Target: AGXT; (-) strand; PAM type: YTN; PAM sequence: CTG
accgacagctggccagagcc

SEQ ID NO: 15476 - DNA, 20 bp, Artificial Sequence
  Description of Artificial Sequence: Synthetic oligonucleotide
  Target: AGXT; (-) strand; PAM type: YTN; PAM sequence: CTG
accctgaccgacagctggcc

SEQ ID NO: 15477 - DNA, 20 bp, Artificial Sequence
  Description of Artificial Sequence: Synthetic oligonucleotide
  Target: AGXT; (-) strand; PAM type: YTN; PAM sequence: CTG
cctgaccctgaccgacagct

SEQ ID NO: 15478 - DNA, 20 bp, Artificial Sequence
  Description of Artificial Sequence: Synthetic oligonucleotide
  Target: AGXT; (-) strand; PAM type: YTN; PAM sequence: CTG
ggacctgcctgaccctgacc

SEQ ID NO: 15479 - DNA, 20 bp, Artificial Sequence
  Description of Artificial Sequence: Synthetic oligonucleotide
  Target: AGXT; (-) strand; PAM type: YTN; PAM sequence: CTC
ccgcctgggacctgcctgac

SEQ ID NO: 15480 - DNA, 20 bp, Artificial Sequence
  Description of Artificial Sequence: Synthetic oligonucleotide
  Target: AGXT; (-) strand; PAM type: YTN; PAM sequence: CTG
acgtcagcctcccgcctggg

SEQ ID NO: 15481 - DNA, 20 bp, Artificial Sequence
  Description of Artificial Sequence: Synthetic oligonucleotide
  Target: AGXT; (-) strand; PAM type: YTN; PAM sequence: CTG
gggggcacagggcgggctga

SEQ ID NO: 15482 - DNA, 20 bp, Artificial Sequence
  Description of Artificial Sequence: Synthetic oligonucleotide
  Target: AGXT; (-) strand; PAM type: YTN; PAM sequence: TTG
cagcccagcaggccgatccg

SEQ ID NO: 15483 - DNA, 20 bp, Artificial Sequence
  Description of Artificial Sequence: Synthetic oligonucleotide
  Target: AGXT; (-) strand; PAM type: YTN; PAM sequence: CTC
gcgggtggcattgcagccca

SEQ ID NO: 15484 - DNA, 20 bp, Artificial Sequence
  Description of Artificial Sequence: Synthetic oligonucleotide
  Target: AGXT; (-) strand; PAM type: YTN; PAM sequence: TTC
tcgcgggtggcattgcagcc

SEQ ID NO: 15485 - DNA, 20 bp, Artificial Sequence
  Description of Artificial Sequence: Synthetic oligonucleotide
  Target: AGXT; (-) strand; PAM type: YTN; PAM sequence: CTC
cgtcacgcggtccacattct

SEQ ID NO: 15486 - DNA, 20 bp, Artificial Sequence
  Description of Artificial Sequence: Synthetic oligonucleotide
  Target: AGXT; (-) strand; PAM type: YTN; PAM sequence: CTC
agggcctccgtcacgcggtc

SEQ ID NO: 15487 - DNA, 20 bp, Artificial Sequence
  Description of Artificial Sequence: Synthetic oligonucleotide
  Target: AGXT; (-) strand; PAM type: YTN; PAM sequence: CTG
cagggccgccctcagggcct

SEQ ID NO: 15488 - DNA, 20 bp, Artificial Sequence
  Description of Artificial Sequence: Synthetic oligonucleotide
  Target: AGXT; (-) strand; PAM type: YTN; PAM sequence: TTG
gggcagtgctgcagggccgc

SEQ ID NO: 15489 - DNA, 20 bp, Artificial Sequence
  Description of Artificial Sequence: Synthetic oligonucleotide
  Target: AGXT; (-) strand; PAM type: YTN; PAM sequence: CTT
ggggcagtgctgcagggccg

SEQ ID NO: 15490 - DNA, 20 bp, Artificial Sequence
  Description of Artificial Sequence: Synthetic oligonucleotide
  Target: AGXT; (-) strand; PAM type: YTN; PAM sequence: TTC
ttggggcagtgctgcagggc

SEQ ID NO: 15491 - DNA, 20 bp, Artificial Sequence
  Description of Artificial Sequence: Synthetic oligonucleotide
  Target: AGXT; (-) strand; PAM type: YTN; PAM sequence: CTT
cttggggcagtgctgcaggg

SEQ ID NO: 15492 - DNA, 20 bp, Artificial Sequence
  Description of Artificial Sequence: Synthetic oligonucleotide
  Target: AGXT; (-) strand; PAM type: YTN; PAM sequence: TTC
ttcttggggcagtgctgcag

SEQ ID NO: 15493 - DNA, 20 bp, Artificial Sequence
  Description of Artificial Sequence: Synthetic oligonucleotide
  Target: AGXT; (-) strand; PAM type: YTN; PAM sequence: CTT
cttcttggggcagtgctgca

SEQ ID NO: 15494 - DNA, 20 bp, Artificial Sequence
  Description of Artificial Sequence: Synthetic oligonucleotide
  Target: AGXT; (-) strand; PAM type: YTN; PAM sequence: CTG
tgtgccagtgggcaggtcac

SEQ ID NO: 15495 - DNA, 20 bp, Artificial Sequence
  Description of Artificial Sequence: Synthetic oligonucleotide
  Target: AGXT; (-) strand; PAM type: YTN; PAM sequence: CTC
agggtgggcatgggacaggt

SEQ ID NO: 15496 - DNA, 20 bp, Artificial Sequence
  Description of Artificial Sequence: Synthetic oligonucleotide
  Target: AGXT; (-) strand; PAM type: YTN; PAM sequence: CTG
atccctcagggtgggcatgg

SEQ ID NO: 15497 - DNA, 20 bp, Artificial Sequence
  Description of Artificial Sequence: Synthetic oligonucleotide
  Target: AGXT; (-) strand; PAM type: YTN; PAM sequence: CTC
ctgatccctcagggtgggca

SEQ ID NO: 15498 - DNA, 20 bp, Artificial Sequence
  Description of Artificial Sequence: Synthetic oligonucleotide
  Target: AGXT; (-) strand; PAM type: YTN; PAM sequence: TTG
ctcctgatccctcagggtgg

SEQ ID NO: 15499 - DNA, 20 bp, Artificial Sequence
  Description of Artificial Sequence: Synthetic oligonucleotide
  Target: AGXT; (-) strand; PAM type: YTN; PAM sequence: TTT
gctcctgatccctcagggtg

SEQ ID NO: 15500 - DNA, 20 bp, Artificial Sequence
  Description of Artificial Sequence: Synthetic oligonucleotide
  Target: AGXT; (-) strand; PAM type: YTN; PAM sequence: CTG
tttgctcctgatccctcagg

SEQ ID NO: 15501 - DNA, 20 bp, Artificial Sequence
  Description of Artificial Sequence: Synthetic oligonucleotide
  Target: AGXT; (-) strand; PAM type: YTN; PAM sequence: TTG
cagggtctgtttgctcctga

SEQ ID NO: 15502 - DNA, 20 bp, Artificial Sequence
  Description of Artificial Sequence: Synthetic oligonucleotide
  Target: AGXT; (-) strand; PAM type: YTN; PAM sequence: CTT
gcagggtctgtttgctcctg

SEQ ID NO: 15503 - DNA, 20 bp, Artificial Sequence
  Description of Artificial Sequence: Synthetic oligonucleotide
  Target: AGXT; (-) strand; PAM type: YTN; PAM sequence: CTG
gaggaccttgcagggtctgt

SEQ ID NO: 15504 - DNA, 20 bp, Artificial Sequence
  Description of Artificial Sequence: Synthetic oligonucleotide
  Target: AGXT; (-) strand; PAM type: YTN; PAM sequence: CTG
tccccaggcctggaggacct

SEQ ID NO: 15505 - DNA, 20 bp, Artificial Sequence
  Description of Artificial Sequence: Synthetic oligonucleotide
  Target: AGXT; (-) strand; PAM type: YTN; PAM sequence: TTC
ctgtccccaggcctggagga

SEQ ID NO: 15506 - DNA, 20 bp, Artificial Sequence
  Description of Artificial Sequence: Synthetic oligonucleotide
  Target: AGXT; (-) strand; PAM type: YTN; PAM sequence: TTT
cctgtccccaggcctggagg

SEQ ID NO: 15507 - DNA, 20 bp, Artificial Sequence
  Description of Artificial Sequence: Synthetic oligonucleotide
  Target: AGXT; (-) strand; PAM type: YTN; PAM sequence: CTT
tcctgtccccaggcctggag

SEQ ID NO: 15508 - DNA, 20 bp, Artificial Sequence
  Description of Artificial Sequence: Synthetic oligonucleotide
  Target: AGXT; (-) strand; PAM type: YTN; PAM sequence: CTG
ggtcagtggctttcctgtcc

SEQ ID NO: 15509 - DNA, 20 bp, Artificial Sequence
  Description of Artificial Sequence: Synthetic oligonucleotide
  Target: AGXT; (-) strand; PAM type: YTN; PAM sequence: CTC
ccgggctgggtcagtggctt

SEQ ID NO: 15510 - DNA, 20 bp, Artificial Sequence
  Description of Artificial Sequence: Synthetic oligonucleotide
  Target: AGXT; (-) strand; PAM type: YTN; PAM sequence: CTG
cctcccgggctgggtcagtg

SEQ ID NO: 15511 - DNA, 20 bp, Artificial Sequence
  Description of Artificial Sequence: Synthetic oligonucleotide
  Target: AGXT; (-) strand; PAM type: YTN; PAM sequence: TTC
tgcctcccgggctgggtcag

SEQ ID NO: 15512 - DNA, 20 bp, Artificial Sequence
  Description of Artificial Sequence: Synthetic oligonucleotide
  Target: AGXT; (-) strand; PAM type: YTN; PAM sequence: CTG
gttctgcctcccgggctggg

SEQ ID NO: 15513 - DNA, 20 bp, Artificial Sequence
  Description of Artificial Sequence: Synthetic oligonucleotide
  Target: AGXT; (-) strand; PAM type: YTN; PAM sequence: CTG
cctggttctgcctcccgggc

SEQ ID NO: 15514 - DNA, 20 bp, Artificial Sequence
  Description of Artificial Sequence: Synthetic oligonucleotide
  Target: AGXT; (-) strand; PAM type: YTN; PAM sequence: CTG
gggccagggaggctgcctgg

SEQ ID NO: 15515 - DNA, 20 bp, Artificial Sequence
  Description of Artificial Sequence: Synthetic oligonucleotide
  Target: AGXT; (-) strand; PAM type: YTN; PAM sequence: CTG
cctggggccagggaggctgc

SEQ ID NO: 15516 - DNA, 20 bp, Artificial Sequence
  Description of Artificial Sequence: Synthetic oligonucleotide
  Target: AGXT; (-) strand; PAM type: YTN; PAM sequence: CTG
gagggaaaagggctgcctgg

SEQ ID NO: 15517 - DNA, 20 bp, Artificial Sequence
  Description of Artificial Sequence: Synthetic oligonucleotide
  Target: AGXT; (-) strand; PAM type: YTN; PAM sequence: TTC
caggaggtgccactggaggg

SEQ ID NO: 15518 - DNA, 20 bp, Artificial Sequence
  Description of Artificial Sequence: Synthetic oligonucleotide
  Target: AGXT; (-) strand; PAM type: YTN; PAM sequence: TTT
ccaggaggtgccactggagg

SEQ ID NO: 15519 - DNA, 20 bp, Artificial Sequence
  Description of Artificial Sequence: Synthetic oligonucleotide
  Target: AGXT; (-) strand; PAM type: YTN; PAM sequence: CTG
tttccaggaggtgccactgg

SEQ ID NO: 15520 - DNA, 20 bp, Artificial Sequence
  Description of Artificial Sequence: Synthetic oligonucleotide
  Target: AGXT; (-) strand; PAM type: YTN; PAM sequence: TTG
cgcccaagtggactgtttcc

SEQ ID NO: 15521 - DNA, 20 bp, Artificial Sequence
  Description of Artificial Sequence: Synthetic oligonucleotide
  Target: AGXT; (-) strand; PAM type: YTN; PAM sequence: TTT
gcgcccaagtggactgtttc

SEQ ID NO: 15522 - DNA, 20 bp, Artificial Sequence
  Description of Artificial Sequence: Synthetic oligonucleotide
  Target: AGXT; (-) strand; PAM type: YTN; PAM sequence: TTT
tgcgcccaagtggactgttt

SEQ ID NO: 15523 - DNA, 20 bp, Artificial Sequence
  Description of Artificial Sequence: Synthetic oligonucleotide
  Target: AGXT; (-) strand; PAM type: YTN; PAM sequence: CTG
ggttttgcgcccaagtggac

SEQ ID NO: 15524 - DNA, 20 bp, Artificial Sequence
  Description of Artificial Sequence: Synthetic oligonucleotide
  Target: AGXT; (-) strand; PAM type: YTN; PAM sequence: TTG
gaaggcactgggttttgcgc

SEQ ID NO: 15525 - DNA, 20 bp, Artificial Sequence
  Description of Artificial Sequence: Synthetic oligonucleotide
  Target: AGXT; (-) strand; PAM type: YTN; PAM sequence: TTT
ggaaggcactgggttttgcg

SEQ ID NO: 15526 - DNA, 20 bp, Artificial Sequence
  Description of Artificial Sequence: Synthetic oligonucleotide
  Target: AGXT; (-) strand; PAM type: YTN; PAM sequence: CTC
atttggaaggcactgggttt

SEQ ID NO: 15527 - DNA, 20 bp, Artificial Sequence
  Description of Artificial Sequence: Synthetic oligonucleotide
  Target: AGXT; (-) strand; PAM type: YTN; PAM sequence: CTG
cagctcatttggaaggcact

SEQ ID NO: 15528 - DNA, 20 bp, Artificial Sequence
  Description of Artificial Sequence: Synthetic oligonucleotide
  Target: AGXT; (-) strand; PAM type: YTN; PAM sequence: CTG
gggactgcagctcatttgga

SEQ ID NO: 15529 - DNA, 20 bp, Artificial Sequence
  Description of Artificial Sequence: Synthetic oligonucleotide
  Target: AGXT; (-) strand; PAM type: YTN; PAM sequence: CTC
atggcctggggactgcagct

SEQ ID NO: 15530 - DNA, 20 bp, Artificial Sequence
  Description of Artificial Sequence: Synthetic oligonucleotide
  Target: AGXT; (-) strand; PAM type: YTN; PAM sequence: TTC
ccgggaggctcatggcctgg

SEQ ID NO: 15531 - DNA, 20 bp, Artificial Sequence
  Description of Artificial Sequence: Synthetic oligonucleotide
  Target: AGXT; (-) strand; PAM type: YTN; PAM sequence: TTA
aacattcccgggaggctcat

SEQ ID NO: 15532 - DNA, 20 bp, Artificial Sequence
  Description of Artificial Sequence: Synthetic oligonucleotide
  Target: AGXT; (-) strand; PAM type: YTN; PAM sequence: TTA
ttaaacattcccgggaggct

SEQ ID NO: 15533 - DNA, 20 bp, Artificial Sequence
  Description of Artificial Sequence: Synthetic oligonucleotide
  Target: AGXT; (-) strand; PAM type: YTN; PAM sequence: TTT
attaaacattcccgggaggc

SEQ ID NO: 15534 - DNA, 20 bp, Artificial Sequence
  Description of Artificial Sequence: Synthetic oligonucleotide
  Target: AGXT; (-) strand; PAM type: YTN; PAM sequence: CTT
tattaaacattcccgggagg

SEQ ID NO: 15535 - DNA, 20 bp, Artificial Sequence
  Description of Artificial Sequence: Synthetic oligonucleotide
  Target: AGXT; (-) strand; PAM type: YTN; PAM sequence: TTG
gccaggccctttattaaaca

SEQ ID NO: 15536 - DNA, 20 bp, Artificial Sequence
  Description of Artificial Sequence: Synthetic oligonucleotide
  Target: AGXT; (-) strand; PAM type: YTN; PAM sequence: TTC
acagaccaccccacacagtg

SEQ ID NO: 15537 - DNA, 20 bp, Artificial Sequence
  Description of Artificial Sequence: Synthetic oligonucleotide
  Target: AGXT; (-) strand; PAM type: YTN; PAM sequence: TTT
cacagaccaccccacacagt

SEQ ID NO: 15538 - DNA, 20 bp, Artificial Sequence
  Description of Artificial Sequence: Synthetic oligonucleotide
  Target: AGXT; (-) strand; PAM type: YTN; PAM sequence: CTT
tcacagaccaccccacacag

SEQ ID NO: 15539 - DNA, 20 bp, Artificial Sequence
  Description of Artificial Sequence: Synthetic oligonucleotide
  Target: AGXT; (-) strand; PAM type: YTN; PAM sequence: CTC
tttcacagaccaccccacac

SEQ ID NO: 15540 - DNA, 20 bp, Artificial Sequence
  Description of Artificial Sequence: Synthetic oligonucleotide
  Target: AGXT; (-) strand; PAM type: YTN; PAM sequence: CTC
actctttcacagaccacccc

SEQ ID NO: 15541 - DNA, 20 bp, Artificial Sequence
  Description of Artificial Sequence: Synthetic oligonucleotide
  Target: AGXT; (-) strand; PAM type: YTN; PAM sequence: CTC
tcactctttcacagaccacc

SEQ ID NO: 15542 - DNA, 20 bp, Artificial Sequence
  Description of Artificial Sequence: Synthetic oligonucleotide
  Target: AGXT; (-) strand; PAM type: YTN; PAM sequence: CTC
ctctcactctttcacagacc

SEQ ID NO: 15543 - DNA, 20 bp, Artificial Sequence
  Description of Artificial Sequence: Synthetic oligonucleotide
  Target: AGXT; (-) strand; PAM type: YTN; PAM sequence: CTC
tcctctcactctttcacaga

SEQ ID NO: 15544 - DNA, 20 bp, Artificial Sequence
  Description of Artificial Sequence: Synthetic oligonucleotide
  Target: AGXT; (-) strand; PAM type: YTN; PAM sequence: CTC
agggagcagagatgctctcc

SEQ ID NO: 15545 - DNA, 20 bp, Artificial Sequence
  Description of Artificial Sequence: Synthetic oligonucleotide
  Target: AGXT; (-) strand; PAM type: YTN; PAM sequence: CTA
aagtccacaatcaggcagct

SEQ ID NO: 15546 - DNA, 20 bp, Artificial Sequence
  Description of Artificial Sequence: Synthetic oligonucleotide
  Target: AGXT; (-) strand; PAM type: YTN; PAM sequence: CTC
caggatgaggagtgtccccc

SEQ ID NO: 15547 - DNA, 20 bp, Artificial Sequence
  Description of Artificial Sequence: Synthetic oligonucleotide
  Target: AGXT; (-) strand; PAM type: YTN; PAM sequence: CTG
tgggctccaggatgaggagt

SEQ ID NO: 15548 - DNA, 20 bp, Artificial Sequence
  Description of Artificial Sequence: Synthetic oligonucleotide
  Target: AGXT; (-) strand; PAM type: YTN; PAM sequence: CTA
ccctgtgggctccaggatga

SEQ ID NO: 15549 - DNA, 20 bp, Artificial Sequence
  Description of Artificial Sequence: Synthetic oligonucleotide
  Target: AGXT; (-) strand; PAM type: YTN; PAM sequence: CTC
caggggaggatctaccctgt

SEQ ID NO: 15550 - DNA, 20 bp, Artificial Sequence
  Description of Artificial Sequence: Synthetic oligonucleotide
  Target: AGXT; (-) strand; PAM type: YTN; PAM sequence: CTC
ctccaggggaggatctaccc

SEQ ID NO: 15551 - DNA, 20 bp, Artificial Sequence
  Description of Artificial Sequence: Synthetic oligonucleotide
  Target: AGXT; (-) strand; PAM type: YTN; PAM sequence: CTA
gagtgtggtgacagcacctc

SEQ ID NO: 15552 - DNA, 20 bp, Artificial Sequence
  Description of Artificial Sequence: Synthetic oligonucleotide
  Target: AGXT; (-) strand; PAM type: YTN; PAM sequence: CTG
gggctagagtgtggtgacag

SEQ ID NO: 15553 - DNA, 20 bp, Artificial Sequence
  Description of Artificial Sequence: Synthetic oligonucleotide
  Target: AGXT; (-) strand; PAM type: YTN; PAM sequence: TTG
ggggtgtgacatctggggct

SEQ ID NO: 15554 - DNA, 20 bp, Artificial Sequence
  Description of Artificial Sequence: Synthetic oligonucleotide
  Target: AGXT; (-) strand; PAM type: YTN; PAM sequence: TTT
gggggtgtgacatctggggc

SEQ ID NO: 15555 - DNA, 20 bp, Artificial Sequence
  Description of Artificial Sequence: Synthetic oligonucleotide
  Target: AGXT; (-) strand; PAM type: YTN; PAM sequence: CTG
gatgtggtgcgtgaggacgt

SEQ ID NO: 15556 - DNA, 20 bp, Artificial Sequence
  Description of Artificial Sequence: Synthetic oligonucleotide
  Target: AGXT; (-) strand; PAM type: YTN; PAM sequence: TTC
acctggatgtggtgcgtgag

SEQ ID NO: 15557 - DNA, 20 bp, Artificial Sequence
  Description of Artificial Sequence: Synthetic oligonucleotide
  Target: AGXT; (-) strand; PAM type: YTN; PAM sequence: CTG
tgcgccgtgtgggttcacct

SEQ ID NO: 15558 - DNA, 20 bp, Artificial Sequence
  Description of Artificial Sequence: Synthetic oligonucleotide
  Target: AGXT; (-) strand; PAM type: YTN; PAM sequence: CTC
caaccagccctgtgcgccgt

SEQ ID NO: 15559 - DNA, 20 bp, Artificial Sequence
  Description of Artificial Sequence: Synthetic oligonucleotide
  Target: AGXT; (-) strand; PAM type: YTN; PAM sequence: TTG
tccatgacaggggtctccaa

SEQ ID NO: 15560 - DNA, 20 bp, Artificial Sequence
  Description of Artificial Sequence: Synthetic oligonucleotide
  Target: AGXT; (-) strand; PAM type: YTN; PAM sequence: CTT
gtccatgacaggggtctcca

SEQ ID NO: 15561 - DNA, 20 bp, Artificial Sequence
  Description of Artificial Sequence: Synthetic oligonucleotide
  Target: AGXT; (-) strand; PAM type: YTN; PAM sequence: CTC
cagcacgcaggtacccttgt

SEQ ID NO: 15562 - DNA, 20 bp, Artificial Sequence
  Description of Artificial Sequence: Synthetic oligonucleotide
  Target: AGXT; (-) strand; PAM type: YTN; PAM sequence: CTC
tccagcacgcaggtaccctt

SEQ ID NO: 15563 - DNA, 20 bp, Artificial Sequence
  Description of Artificial Sequence: Synthetic oligonucleotide
  Target: AGXT; (-) strand; PAM type: YTN; PAM sequence: CTG
tgcgctctccagcacgcagg

SEQ ID NO: 15564 - DNA, 20 bp, Artificial Sequence
  Description of Artificial Sequence: Synthetic oligonucleotide
  Target: AGXT; (-) strand; PAM type: YTN; PAM sequence: CTG
gctgtgcgctctccagcacg

SEQ ID NO: 15565 - DNA, 20 bp, Artificial Sequence
  Description of Artificial Sequence: Synthetic oligonucleotide
  Target: AGXT; (-) strand; PAM type: YTN; PAM sequence: CTC
aggtcctggctgtgcgctct

SEQ ID NO: 15566 - DNA, 20 bp, Artificial Sequence
  Description of Artificial Sequence: Synthetic oligonucleotide
  Target: AGXT; (-) strand; PAM type: YTN; PAM sequence: TTC
cacgtgtcatgggctcaggt

SEQ ID NO: 15567 - DNA, 20 bp, Artificial Sequence
  Description of Artificial Sequence: Synthetic oligonucleotide
  Target: AGXT; (-) strand; PAM type: YTN; PAM sequence: CTT
ccacgtgtcatgggctcagg

SEQ ID NO: 15568 - DNA, 20 bp, Artificial Sequence
  Description of Artificial Sequence: Synthetic oligonucleotide
  Target: AGXT; (-) strand; PAM type: YTN; PAM sequence: TTG
gaggcttccacgtgtcatgg

SEQ ID NO: 15569 - DNA, 20 bp, Artificial Sequence
  Description of Artificial Sequence: Synthetic oligonucleotide
  Target: AGXT; (-) strand; PAM type: YTN; PAM sequence: TTC
cattggaggcttccacgtgt

SEQ ID NO: 15570 - DNA, 20 bp, Artificial Sequence
  Description of Artificial Sequence: Synthetic oligonucleotide
  Target: AGXT; (-) strand; PAM type: YTN; PAM sequence: CTT
ccattggaggcttccacgtg

SEQ ID NO: 15571 - DNA, 20 bp, Artificial Sequence
  Description of Artificial Sequence: Synthetic oligonucleotide
  Target: AGXT; (-) strand; PAM type: YTN; PAM sequence: CTG
gatgggagcataggggacct

SEQ ID NO: 15572 - DNA, 20 bp, Artificial Sequence
  Description of Artificial Sequence: Synthetic oligonucleotide
  Target: AGXT; (-) strand; PAM type: YTN; PAM sequence: CTG
gctggatgggagcatagggg

SEQ ID NO: 15573 - DNA, 20 bp, Artificial Sequence
  Description of Artificial Sequence: Synthetic oligonucleotide
  Target: AGXT; (-) strand; PAM type: YTN; PAM sequence: TTG
aggggtgggcactggctgga

SEQ ID NO: 15574 - DNA, 20 bp, Artificial Sequence
  Description of Artificial Sequence: Synthetic oligonucleotide
  Target: AGXT; (-) strand; PAM type: YTN; PAM sequence: CTA
tggtcacagaagtcaggcag

SEQ ID NO: 15575 - DNA, 20 bp, Artificial Sequence
  Description of Artificial Sequence: Synthetic oligonucleotide
  Target: AGXT; (-) strand; PAM type: YTN; PAM sequence: CTG
atctatggtcacagaagtca

SEQ ID NO: 15576 - DNA, 20 bp, Artificial Sequence
  Description of Artificial Sequence: Synthetic oligonucleotide
  Target: AGXT; (-) strand; PAM type: YTN; PAM sequence: TTC
aaatatgccaggctgatcta

SEQ ID NO: 15577 - DNA, 20 bp, Artificial Sequence
  Description of Artificial Sequence: Synthetic oligonucleotide
  Target: AGXT; (-) strand; PAM type: YTN; PAM sequence: TTC
aaaataaataaataaattca

SEQ ID NO: 15578 - DNA, 20 bp, Artificial Sequence
  Description of Artificial Sequence: Synthetic oligonucleotide
  Target: AGXT; (-) strand; PAM type: YTN; PAM sequence: TTT
caaaataaataaataaattc

SEQ ID NO: 15579 - DNA, 20 bp, Artificial Sequence
  Description of Artificial Sequence: Synthetic oligonucleotide
  Target: AGXT; (-) strand; PAM type: YTN; PAM sequence: CTC
cgtttcaaaataaataaata

SEQ ID NO: 15580 - DNA, 20 bp, Artificial Sequence
  Description of Artificial Sequence: Synthetic oligonucleotide
  Target: AGXT; (-) strand; PAM type: YTN; PAM sequence: CTG
ggcaacaagagtgaaactcc

SEQ ID NO: 15581 - DNA, 20 bp, Artificial Sequence
  Description of Artificial Sequence: Synthetic oligonucleotide
  Target: AGXT; (-) strand; PAM type: YTN; PAM sequence: CTC
cagcctgggcaacaagagtg

SEQ ID NO: 15582 - DNA, 20 bp, Artificial Sequence
  Description of Artificial Sequence: Synthetic oligonucleotide
  Target: AGXT; (-) strand; PAM type: YTN; PAM sequence: CTG
cactccagcctgggcaacaa

SEQ ID NO: 15583 - DNA, 20 bp, Artificial Sequence
  Description of Artificial Sequence: Synthetic oligonucleotide
  Target: AGXT; (-) strand; PAM type: YTN; PAM sequence: CTG
agatcgtgccactgcactcc

SEQ ID NO: 15584 - DNA, 20 bp, Artificial Sequence
  Description of Artificial Sequence: Synthetic oligonucleotide
  Target: AGXT; (-) strand; PAM type: YTN; PAM sequence: TTG
tagtgagctgagatcgtgcc

SEQ ID NO: 15585 - DNA, 20 bp, Artificial Sequence
  Description of Artificial Sequence: Synthetic oligonucleotide
  Target: AGXT; (-) strand; PAM type: YTN; PAM sequence: TTG
aacccgggaggcggaggttg

SEQ ID NO: 15586 - DNA, 20 bp, Artificial Sequence
  Description of Artificial Sequence: Synthetic oligonucleotide
  Target: AGXT; (-) strand; PAM type: YTN; PAM sequence: CTT
gaacccgggaggcggaggtt

SEQ ID NO: 15587 - DNA, 20 bp, Artificial Sequence
  Description of Artificial Sequence: Synthetic oligonucleotide
  Target: AGXT; (-) strand; PAM type: YTN; PAM sequence: CTG
aggcaggagaatcgcttgaa

SEQ ID NO: 15588 - DNA, 20 bp, Artificial Sequence
  Description of Artificial Sequence: Synthetic oligonucleotide
  Target: AGXT; (-) strand; PAM type: YTN; PAM sequence: CTA
atccggagcctgaggcagga

SEQ ID NO: 15589 - DNA, 20 bp, Artificial Sequence
  Description of Artificial Sequence: Synthetic oligonucleotide
  Target: AGXT; (-) strand; PAM type: YTN; PAM sequence: CTG
tagtcccagctaatccggag

SEQ ID NO: 15590 - DNA, 20 bp, Artificial Sequence
  Description of Artificial Sequence: Synthetic oligonucleotide
  Target: AGXT; (-) strand; PAM type: YTN; PAM sequence: TTA
gccgggcatggtggtgcaca

SEQ ID NO: 15591 - DNA, 20 bp, Artificial Sequence
  Description of Artificial Sequence: Synthetic oligonucleotide
  Target: AGXT; (-) strand; PAM type: YTN; PAM sequence: CTA
aaaatacaaaaattagccgg

SEQ ID NO: 15592 - DNA, 20 bp, Artificial Sequence
  Description of Artificial Sequence: Synthetic oligonucleotide
  Target: AGXT; (-) strand; PAM type: YTN; PAM sequence: CTG
tactaaaaatacaaaaatta

SEQ ID NO: 15593 - DNA, 20 bp, Artificial Sequence
  Description of Artificial Sequence: Synthetic oligonucleotide
  Target: AGXT; (-) strand; PAM type: YTN; PAM sequence: CTG
gccaatatagtgaaacccca

SEQ ID NO: 15594 - DNA, 20 bp, Artificial Sequence
  Description of Artificial Sequence: Synthetic oligonucleotide
  Target: AGXT; (-) strand; PAM type: YTN; PAM sequence: TTC
gagaccagcctggccaatat

SEQ ID NO: 15595 - DNA, 20 bp, Artificial Sequence
  Description of Artificial Sequence: Synthetic oligonucleotide
  Target: AGXT; (-) strand; PAM type: YTN; PAM sequence: TTG
aggtcaggagttcgagacca

SEQ ID NO: 15596 - DNA, 20 bp, Artificial Sequence
  Description of Artificial Sequence: Synthetic oligonucleotide
  Target: AGXT; (-) strand; PAM type: YTN; PAM sequence: CTT
gaggtcaggagttcgagacc

SEQ ID NO: 15597 - DNA, 20 bp, Artificial Sequence
  Description of Artificial Sequence: Synthetic oligonucleotide
  Target: AGXT; (-) strand; PAM type: YTN; PAM sequence: TTG
ggaggccgaggcaggtggat

SEQ ID NO: 15598 - DNA, 20 bp, Artificial Sequence
  Description of Artificial Sequence: Synthetic oligonucleotide
  Target: AGXT; (-) strand; PAM type: YTN; PAM sequence: TTT
gggaggccgaggcaggtgga

SEQ ID NO: 15599 - DNA, 20 bp, Artificial Sequence
  Description of Artificial Sequence: Synthetic oligonucleotide
  Target: AGXT; (-) strand; PAM type: YTN; PAM sequence: CTT
tgggaggccgaggcaggtgg

SEQ ID NO: 15600 - DNA, 20 bp, Artificial Sequence
  Description of Artificial Sequence: Synthetic oligonucleotide
  Target: AGXT; (-) strand; PAM type: YTN; PAM sequence: TTG
taatcccagcactttgggag

SEQ ID NO: 15601 - DNA, 20 bp, Artificial Sequence
  Description of Artificial Sequence: Synthetic oligonucleotide
  Target: AGXT; (-) strand; PAM type: YTN; PAM sequence: CTT
gtaatcccagcactttggga

SEQ ID NO: 15602 - DNA, 20 bp, Artificial Sequence
  Description of Artificial Sequence: Synthetic oligonucleotide
  Target: AGXT; (-) strand; PAM type: YTN; PAM sequence: CTC
acgcttgtaatcccagcact

SEQ ID NO: 15603 - DNA, 20 bp, Artificial Sequence
  Description of Artificial Sequence: Synthetic oligonucleotide
  Target: AGXT; (-) strand; PAM type: YTN; PAM sequence: CTG
ggcacagtggctcacgcttg

SEQ ID NO: 15604 - DNA, 20 bp, Artificial Sequence
  Description of Artificial Sequence: Synthetic oligonucleotide
  Target: AGXT; (-) strand; PAM type: YTN; PAM sequence: CTA
tggctgggcacagtggctca

SEQ ID NO: 15605 - DNA, 20 bp, Artificial Sequence
  Description of Artificial Sequence: Synthetic oligonucleotide
  Target: AGXT; (-) strand; PAM type: YTN; PAM sequence: TTC
aactatggctgggcacagtg

SEQ ID NO: 15606 - DNA, 20 bp, Artificial Sequence
  Description of Artificial Sequence: Synthetic oligonucleotide
  Target: AGXT; (-) strand; PAM type: YTN; PAM sequence: CTG
accatgaaattcaactatgg

SEQ ID NO: 15607 - DNA, 20 bp, Artificial Sequence
  Description of Artificial Sequence: Synthetic oligonucleotide
  Target: AGXT; (-) strand; PAM type: YTN; PAM sequence: TTC
cactgaccatgaaattcaac

SEQ ID NO: 15608 - DNA, 20 bp, Artificial Sequence
  Description of Artificial Sequence: Synthetic oligonucleotide
  Target: AGXT; (-) strand; PAM type: YTN; PAM sequence: CTG
tgtgttccactgaccatgaa

SEQ ID NO: 15609 - DNA, 20 bp, Artificial Sequence
  Description of Artificial Sequence: Synthetic oligonucleotide
  Target: AGXT; (-) strand; PAM type: YTN; PAM sequence: CTG
ctgtgtgttccactgaccat

SEQ ID NO: 15610 - DNA, 20 bp, Artificial Sequence
  Description of Artificial Sequence: Synthetic oligonucleotide
  Target: AGXT; (-) strand; PAM type: YTN; PAM sequence: CTG
gcacagtggaggacctgctg

SEQ ID NO: 15611 - DNA, 20 bp, Artificial Sequence
  Description of Artificial Sequence: Synthetic oligonucleotide
  Target: AGXT; (-) strand; PAM type: YTN; PAM sequence: CTC
agcaacaaagacacaccggc

SEQ ID NO: 15612 - DNA, 20 bp, Artificial Sequence
  Description of Artificial Sequence: Synthetic oligonucleotide
  Target: AGXT; (-) strand; PAM type: YTN; PAM sequence: CTC
agcaacaagacacaccggcg

SEQ ID NO: 15613 - DNA, 20 bp, Artificial Sequence
  Description of Artificial Sequence: Synthetic oligonucleotide
  Target: AGXT; (-) strand; PAM type: YTN; PAM sequence: CTA
tggtgatgaaccaacaaatc

SEQ ID NO: 15614 - DNA, 20 bp, Artificial Sequence
  Description of Artificial Sequence: Synthetic oligonucleotide
  Target: AGXT; (-) strand; PAM type: YTN; PAM sequence: CTC
aactatggtgatgaaccaac

SEQ ID NO: 15615 - DNA, 20 bp, Artificial Sequence
  Description of Artificial Sequence: Synthetic oligonucleotide
  Target: AGXT; (-) strand; PAM type: YTN; PAM sequence: TTC
ataacagccccaaaatagaa

SEQ ID NO: 15616 - DNA, 20 bp, Artificial Sequence
  Description of Artificial Sequence: Synthetic oligonucleotide
  Target: AGXT; (-) strand; PAM type: YTN; PAM sequence: CTC
cgtattcataacagccccaa

SEQ ID NO: 15617 - DNA, 20 bp, Artificial Sequence
  Description of Artificial Sequence: Synthetic oligonucleotide
  Target: AGXT; (-) strand; PAM type: YTN; PAM sequence: CTA
cctccgtattcataacagcc

SEQ ID NO: 15618 - DNA, 20 bp, Artificial Sequence
  Description of Artificial Sequence: Synthetic oligonucleotide
  Target: AGXT; (-) strand; PAM type: YTN; PAM sequence: TTC
actacctccgtattcataac

SEQ ID NO: 15619 - DNA, 20 bp, Artificial Sequence
  Description of Artificial Sequence: Synthetic oligonucleotide
  Target: AGXT; (-) strand; PAM type: YTN; PAM sequence: TTT
cactacctccgtattcataa

SEQ ID NO: 15620 - DNA, 20 bp, Artificial Sequence
  Description of Artificial Sequence: Synthetic oligonucleotide
  Target: AGXT; (-) strand; PAM type: YTN; PAM sequence: TTG
agtaagaatttcactacctc

SEQ ID NO: 15621 - DNA, 20 bp, Artificial Sequence
  Description of Artificial Sequence: Synthetic oligonucleotide
  Target: AGXT; (-) strand; PAM type: YTN; PAM sequence: CTT
gagtaagaatttcactacct

SEQ ID NO: 15622 - DNA, 20 bp, Artificial Sequence
  Description of Artificial Sequence: Synthetic oligonucleotide
  Target: AGXT; (-) strand; PAM type: YTN; PAM sequence: TTA
tccaagaaaaatgaaaatat

SEQ ID NO: 15623 - DNA, 20 bp, Artificial Sequence
  Description of Artificial Sequence: Synthetic oligonucleotide
  Target: AGXT; (-) strand; PAM type: YTN; PAM sequence: TTT
atccaagaaaaatgaaaata

SEQ ID NO: 15624 - DNA, 20 bp, Artificial Sequence
  Description of Artificial Sequence: Synthetic oligonucleotide
  Target: AGXT; (-) strand; PAM type: YTN; PAM sequence: TTA
tttatccaagaaaaatgaaa

SEQ ID NO: 15625 - DNA, 20 bp, Artificial Sequence
  Description of Artificial Sequence: Synthetic oligonucleotide
  Target: AGXT; (-) strand; PAM type: YTN; PAM sequence: CTA
gttatttatccaagaaaaat

SEQ ID NO: 15626 - DNA, 20 bp, Artificial Sequence
  Description of Artificial Sequence: Synthetic oligonucleotide
  Target: AGXT; (-) strand; PAM type: YTN; PAM sequence: CTC
ctagttatttatccaagaaa

SEQ ID NO: 15627 - DNA, 20 bp, Artificial Sequence
  Description of Artificial Sequence: Synthetic oligonucleotide
  Target: AGXT; (-) strand; PAM type: YTN; PAM sequence: TTC
cactcctagttatttatcca

SEQ ID NO: 15628 - DNA, 20 bp, Artificial Sequence
  Description of Artificial Sequence: Synthetic oligonucleotide
  Target: AGXT; (-) strand; PAM type: YTN; PAM sequence: CTG
caattccactcctagttatt

SEQ ID NO: 15629 - DNA, 20 bp, Artificial Sequence
  Description of Artificial Sequence: Synthetic oligonucleotide
  Target: AGXT; (-) strand; PAM type: YTN; PAM sequence: TTG
tatgaccctgcaattccact

SEQ ID NO: 15630 - DNA, 20 bp, Artificial Sequence
  Description of Artificial Sequence: Synthetic oligonucleotide
  Target: AGXT; (-) strand; PAM type: YTN; PAM sequence: CTA
ttgtatgaccctgcaattcc

SEQ ID NO: 15631 - DNA, 20 bp, Artificial Sequence
  Description of Artificial Sequence: Synthetic oligonucleotide
  Target: AGXT; (-) strand; PAM type: YTN; PAM sequence: TTA
agcctattgtatgaccctgc

SEQ ID NO: 15632 - DNA, 20 bp, Artificial Sequence
  Description of Artificial Sequence: Synthetic oligonucleotide
  Target: AGXT; (-) strand; PAM type: YTN; PAM sequence: CTC
gtataaggttaagcctattg

SEQ ID NO: 15633 - DNA, 20 bp, Artificial Sequence
  Description of Artificial Sequence: Synthetic oligonucleotide
  Target: AGXT; (-) strand; PAM type: YTN; PAM sequence: TTC
gtggcagtctcgtataaggt

SEQ ID NO: 15634 - DNA, 20 bp, Artificial Sequence
  Description of Artificial Sequence: Synthetic oligonucleotide
  Target: AGXT; (-) strand; PAM type: YTN; PAM sequence: TTT
cgtggcagtctcgtataagg

SEQ ID NO: 15635 - DNA, 20 bp, Artificial Sequence
  Description of Artificial Sequence: Synthetic oligonucleotide
  Target: AGXT; (-) strand; PAM type: YTN; PAM sequence: TTC
ggagaatttcgtggcagtct

SEQ ID NO: 15636 - DNA, 20 bp, Artificial Sequence
  Description of Artificial Sequence: Synthetic oligonucleotide
  Target: AGXT; (-) strand; PAM type: YTN; PAM sequence: CTT
cggagaatttcgtggcagtc

SEQ ID NO: 15637 - DNA, 20 bp, Artificial Sequence
  Description of Artificial Sequence: Synthetic oligonucleotide
  Target: AGXT; (-) strand; PAM type: YTN; PAM sequence: CTG
cgggaatgaaacatggaaga

SEQ ID NO: 15638 - DNA, 20 bp, Artificial Sequence
  Description of Artificial Sequence: Synthetic oligonucleotide
  Target: AGXT; (-) strand; PAM type: YTN; PAM sequence: CTG
tagctgcgggaatgaaacat

SEQ ID NO: 15639 - DNA, 20 bp, Artificial Sequence
  Description of Artificial Sequence: Synthetic oligonucleotide
  Target: AGXT; (-) strand; PAM type: YTN; PAM sequence: CTG
gacgctgtagctgcgggaat

SEQ ID NO: 15640 - DNA, 20 bp, Artificial Sequence
  Description of Artificial Sequence: Synthetic oligonucleotide
  Target: AGXT; (-) strand; PAM type: YTN; PAM sequence: CTA
gcaaaaaaagacaacatgga

SEQ ID NO: 15641 - DNA, 20 bp, Artificial Sequence
  Description of Artificial Sequence: Synthetic oligonucleotide
  Target: AGXT; (-) strand; PAM type: YTN; PAM sequence: TTA
caccccctagcaaaaaaaga

SEQ ID NO: 15642 - DNA, 20 bp, Artificial Sequence
  Description of Artificial Sequence: Synthetic oligonucleotide
  Target: AGXT; (-) strand; PAM type: YTN; PAM sequence: TTT
acaccccctagcaaaaaaag

SEQ ID NO: 15643 - DNA, 20 bp, Artificial Sequence
  Description of Artificial Sequence: Synthetic oligonucleotide
  Target: AGXT; (-) strand; PAM type: YTN; PAM sequence: TTT
tacaccccctagcaaaaaaa

SEQ ID NO: 15644 - DNA, 20 bp, Artificial Sequence
  Description of Artificial Sequence: Synthetic oligonucleotide
  Target: AGXT; (-) strand; PAM type: YTN; PAM sequence: CTA
aaaccaaatcagacaggatt

SEQ ID NO: 15645 - DNA, 20 bp, Artificial Sequence
  Description of Artificial Sequence: Synthetic oligonucleotide
  Target: AGXT; (-) strand; PAM type: YTN; PAM sequence: CTC
aacatcaataggcatcaggg

SEQ ID NO: 15646 - DNA, 20 bp, Artificial Sequence
  Description of Artificial Sequence: Synthetic oligonucleotide
  Target: AGXT; (-) strand; PAM type: YTN; PAM sequence: TTG
ctcaacatcaataggcatca

SEQ ID NO: 15647 - DNA, 20 bp, Artificial Sequence
  Description of Artificial Sequence: Synthetic oligonucleotide
  Target: AGXT; (-) strand; PAM type: YTN; PAM sequence: CTC
atgagaagttgctcaacatc

SEQ ID NO: 15648 - DNA, 20 bp, Artificial Sequence
  Description of Artificial Sequence: Synthetic oligonucleotide
  Target: AGXT; (-) strand; PAM type: YTN; PAM sequence: CTA
caaacggccgatagctcatg

SEQ ID NO: 15649 - DNA, 20 bp, Artificial Sequence
  Description of Artificial Sequence: Synthetic oligonucleotide
  Target: AGXT; (-) strand; PAM type: YTN; PAM sequence: TTC
agaagatctacaaacggccg

SEQ ID NO: 15650 - DNA, 20 bp, Artificial Sequence
  Description of Artificial Sequence: Synthetic oligonucleotide
  Target: AGXT; (-) strand; PAM type: YTN; PAM sequence: TTT
cagaagatctacaaacggcc

SEQ ID NO: 15651 - DNA, 20 bp, Artificial Sequence
  Description of Artificial Sequence: Synthetic oligonucleotide
  Target: AGXT; (-) strand; PAM type: YTN; PAM sequence: TTT
tcagaagatctacaaacggc

SEQ ID NO: 15652 - DNA, 20 bp, Artificial Sequence
  Description of Artificial Sequence: Synthetic oligonucleotide
  Target: AGXT; (-) strand; PAM type: YTN; PAM sequence: CTT
ttcagaagatctacaaacgg

SEQ ID NO: 15653 - DNA, 20 bp, Artificial Sequence
  Description of Artificial Sequence: Synthetic oligonucleotide
  Target: AGXT; (-) strand; PAM type: YTN; PAM sequence: CTG
acacttttcagaagatctac

SEQ ID NO: 15654 - DNA, 20 bp, Artificial Sequence
  Description of Artificial Sequence: Synthetic oligonucleotide
  Target: AGXT; (-) strand; PAM type: YTN; PAM sequence: TTG
aactgacacttttcagaaga

SEQ ID NO: 15655 - DNA, 20 bp, Artificial Sequence
  Description of Artificial Sequence: Synthetic oligonucleotide
  Target: AGXT; (-) strand; PAM type: YTN; PAM sequence: TTT
gaactgacacttttcagaag

SEQ ID NO: 15656 - DNA, 20 bp, Artificial Sequence
  Description of Artificial Sequence: Synthetic oligonucleotide
  Target: AGXT; (-) strand; PAM type: YTN; PAM sequence: TTG
acaataagaagataaaaatc

SEQ ID NO: 15657 - DNA, 20 bp, Artificial Sequence
  Description of Artificial Sequence: Synthetic oligonucleotide
  Target: AGXT; (-) strand; PAM type: YTN; PAM sequence: TTA
aaatgatcacacattgacaa

SEQ ID NO: 15658 - DNA, 20 bp, Artificial Sequence
  Description of Artificial Sequence: Synthetic oligonucleotide
  Target: AGXT; (-) strand; PAM type: YTN; PAM sequence: TTT
aaaatgatcacacattgaca

SEQ ID NO: 15659 - DNA, 20 bp, Artificial Sequence
  Description of Artificial Sequence: Synthetic oligonucleotide
  Target: AGXT; (-) strand; PAM type: YTN; PAM sequence: TTT
taaaatgatcacacattgac

SEQ ID NO: 15660 - DNA, 20 bp, Artificial Sequence
  Description of Artificial Sequence: Synthetic oligonucleotide
  Target: AGXT; (-) strand; PAM type: YTN; PAM sequence: CTA
gaatatattttaaaatgatc

SEQ ID NO: 15661 - DNA, 20 bp, Artificial Sequence
  Description of Artificial Sequence: Synthetic oligonucleotide
  Target: AGXT; (-) strand; PAM type: YTN; PAM sequence: CTG
atagtatctagaatatattt

SEQ ID NO: 15662 - DNA, 20 bp, Artificial Sequence
  Description of Artificial Sequence: Synthetic oligonucleotide
  Target: AGXT; (-) strand; PAM type: YTN; PAM sequence: TTC
atgccacacgtatctgatag

SEQ ID NO: 15663 - DNA, 20 bp, Artificial Sequence
  Description of Artificial Sequence: Synthetic oligonucleotide
  Target: AGXT; (-) strand; PAM type: YTN; PAM sequence: CTC
aaaaaaaaaaaaaaaaaaaa

SEQ ID NO: 15664 - DNA, 20 bp, Artificial Sequence
  Description of Artificial Sequence: Synthetic oligonucleotide
  Target: AGXT; (-) strand; PAM type: YTN; PAM sequence: TTC
tcaaaaaaaaaaaaaaaaaa

SEQ ID NO: 15665 - DNA, 20 bp, Artificial Sequence
  Description of Artificial Sequence: Synthetic oligonucleotide
  Target: AGXT; (-) strand; PAM type: YTN; PAM sequence: TTT
ctcaaaaaaaaaaaaaaaaa

SEQ ID NO: 15666 - DNA, 20 bp, Artificial Sequence
  Description of Artificial Sequence: Synthetic oligonucleotide
  Target: AGXT; (-) strand; PAM type: YTN; PAM sequence: CTT
tctcaaaaaaaaaaaaaaaa

SEQ ID NO: 15667 - DNA, 20 bp, Artificial Sequence
  Description of Artificial Sequence: Synthetic oligonucleotide
  Target: AGXT; (-) strand; PAM type: YTN; PAM sequence: TTC
tttctcaaaaaaaaaaaaaa

SEQ ID NO: 15668 - DNA, 20 bp, Artificial Sequence
  Description of Artificial Sequence: Synthetic oligonucleotide
  Target: AGXT; (-) strand; PAM type: YTN; PAM sequence: CTG
gacggagtgagattctttct

SEQ ID NO: 15669 - DNA, 20 bp, Artificial Sequence
  Description of Artificial Sequence: Synthetic oligonucleotide
  Target: AGXT; (-) strand; PAM type: YTN; PAM sequence: CTC
cagcctggacggagtgagat

SEQ ID NO: 15670 - DNA, 20 bp, Artificial Sequence
  Description of Artificial Sequence: Synthetic oligonucleotide
  Target: AGXT; (-) strand; PAM type: YTN; PAM sequence: CTC
tccagcctggacggagtgag

SEQ ID NO: 15671 - DNA, 20 bp, Artificial Sequence
  Description of Artificial Sequence: Synthetic oligonucleotide
  Target: AGXT; (-) strand; PAM type: YTN; PAM sequence: CTG
ctctccagcctggacggagt

SEQ ID NO: 15672 - DNA, 20 bp, Artificial Sequence
  Description of Artificial Sequence: Synthetic oligonucleotide
  Target: AGXT; (-) strand; PAM type: YTN; PAM sequence: CTG
agatcacaccactgctctcc

SEQ ID NO: 15673 - DNA, 20 bp, Artificial Sequence
  Description of Artificial Sequence: Synthetic oligonucleotide
  Target: AGXT; (-) strand; PAM type: YTN; PAM sequence: TTG
cagtgagctgagatcacacc

SEQ ID NO: 15674 - DNA, 20 bp, Artificial Sequence
  Description of Artificial Sequence: Synthetic oligonucleotide
  Target: AGXT; (-) strand; PAM type: YTN; PAM sequence: TTG
aacccgggaggtggaggttg

SEQ ID NO: 15675 - DNA, 20 bp, Artificial Sequence
  Description of Artificial Sequence: Synthetic oligonucleotide
  Target: AGXT; (-) strand; PAM type: YTN; PAM sequence: CTT
gaacccgggaggtggaggtt

SEQ ID NO: 15676 - DNA, 20 bp, Artificial Sequence
  Description of Artificial Sequence: Synthetic oligonucleotide
  Target: AGXT; (-) strand; PAM type: YTN; PAM sequence: CTC
ttgaacccgggaggtggagg

SEQ ID NO: 15677 - DNA, 20 bp, Artificial Sequence
  Description of Artificial Sequence: Synthetic oligonucleotide
  Target: AGXT; (-) strand; PAM type: YTN; PAM sequence: CTG
aggcaggagaatctcttgaa

SEQ ID NO: 15678 - DNA, 20 bp, Artificial Sequence
  Description of Artificial Sequence: Synthetic oligonucleotide
  Target: AGXT; (-) strand; PAM type: YTN; PAM sequence: TTG
ggaggctgaggcaggagaat

SEQ ID NO: 15679 - DNA, 20 bp, Artificial Sequence
  Description of Artificial Sequence: Synthetic oligonucleotide
  Target: AGXT; (-) strand; PAM type: YTN; PAM sequence: CTT
gggaggctgaggcaggagaa

SEQ ID NO: 15680 - DNA, 20 bp, Artificial Sequence
  Description of Artificial Sequence: Synthetic oligonucleotide
  Target: AGXT; (-) strand; PAM type: YTN; PAM sequence: CTA
cttgggaggctgaggcagga

SEQ ID NO: 15681 - DNA, 20 bp, Artificial Sequence
  Description of Artificial Sequence: Synthetic oligonucleotide
  Target: AGXT; (-) strand; PAM type: YTN; PAM sequence: CTG
taatcccagctacttgggag

SEQ ID NO: 15682 - DNA, 20 bp, Artificial Sequence
  Description of Artificial Sequence: Synthetic oligonucleotide
  Target: AGXT; (-) strand; PAM type: YTN; PAM sequence: TTA
gccgggtgtggtggtgcatg

SEQ ID NO: 15683 - DNA, 20 bp, Artificial Sequence
  Description of Artificial Sequence: Synthetic oligonucleotide
  Target: AGXT; (-) strand; PAM type: YTN; PAM sequence: CTA
caaaaaaacacaaaaattag

SEQ ID NO: 15684 - DNA, 20 bp, Artificial Sequence
  Description of Artificial Sequence: Synthetic oligonucleotide
  Target: AGXT; (-) strand; PAM type: YTN; PAM sequence: CTC
tacaaaaaaacacaaaaatt

SEQ ID NO: 15685 - DNA, 20 bp, Artificial Sequence
  Description of Artificial Sequence: Synthetic oligonucleotide
  Target: AGXT; (-) strand; PAM type: YTN; PAM sequence: CTG
gccaacatggcaaaaccccg

SEQ ID NO: 15686 - DNA, 20 bp, Artificial Sequence
  Description of Artificial Sequence: Synthetic oligonucleotide
  Target: AGXT; (-) strand; PAM type: YTN; PAM sequence: TTG
agaccagcctggccaacatg

SEQ ID NO: 15687 - DNA, 20 bp, Artificial Sequence
  Description of Artificial Sequence: Synthetic oligonucleotide
  Target: AGXT; (-) strand; PAM type: YTN; PAM sequence: TTT
gagaccagcctggccaacat

SEQ ID NO: 15688 - DNA, 20 bp, Artificial Sequence
  Description of Artificial Sequence: Synthetic oligonucleotide
  Target: AGXT; (-) strand; PAM type: YTN; PAM sequence: TTG
aggtcaggaatttgagacca

SEQ ID NO: 15689 - DNA, 20 bp, Artificial Sequence
  Description of Artificial Sequence: Synthetic oligonucleotide
  Target: AGXT; (-) strand; PAM type: YTN; PAM sequence: CTT
gaggtcaggaatttgagacc

SEQ ID NO: 15690 - DNA, 20 bp, Artificial Sequence
  Description of Artificial Sequence: Synthetic oligonucleotide
  Target: AGXT; (-) strand; PAM type: YTN; PAM sequence: CTG
aggtgggtggatcacttgag

SEQ ID NO: 15691 - DNA, 20 bp, Artificial Sequence
  Description of Artificial Sequence: Synthetic oligonucleotide
  Target: AGXT; (-) strand; PAM type: YTN; PAM sequence: TTG
ggaggctgaggtgggtggat

SEQ ID NO: 15692 - DNA, 20 bp, Artificial Sequence
  Description of Artificial Sequence: Synthetic oligonucleotide
  Target: AGXT; (-) strand; PAM type: YTN; PAM sequence: TTT
gggaggctgaggtgggtgga

SEQ ID NO: 15693 - DNA, 20 bp, Artificial Sequence
  Description of Artificial Sequence: Synthetic oligonucleotide
  Target: AGXT; (-) strand; PAM type: YTN; PAM sequence: CTT
tgggaggctgaggtgggtgg

SEQ ID NO: 15694 - DNA, 20 bp, Artificial Sequence
  Description of Artificial Sequence: Synthetic oligonucleotide
  Target: AGXT; (-) strand; PAM type: YTN; PAM sequence: CTG
taatcccagcactttgggag

SEQ ID NO: 15695 - DNA, 20 bp, Artificial Sequence
  Description of Artificial Sequence: Synthetic oligonucleotide
  Target: AGXT; (-) strand; PAM type: YTN; PAM sequence: CTC
atgcctgtaatcccagcact

SEQ ID NO: 15696 - DNA, 20 bp, Artificial Sequence
  Description of Artificial Sequence: Synthetic oligonucleotide
  Target: AGXT; (-) strand; PAM type: YTN; PAM sequence: CTG
ggtgtggtggctcatgcctg

SEQ ID NO: 15697 - DNA, 20 bp, Artificial Sequence
  Description of Artificial Sequence: Synthetic oligonucleotide
  Target: AGXT; (-) strand; PAM type: YTN; PAM sequence: TTA
agaaaatgaataggtaagct

SEQ ID NO: 15698 - DNA, 20 bp, Artificial Sequence
  Description of Artificial Sequence: Synthetic oligonucleotide
  Target: AGXT; (-) strand; PAM type: YTN; PAM sequence: TTG
aaagacacaattaagaaaat

SEQ ID NO: 15699 - DNA, 20 bp, Artificial Sequence
  Description of Artificial Sequence: Synthetic oligonucleotide
  Target: AGXT; (-) strand; PAM type: YTN; PAM sequence: TTT
gaaagacacaattaagaaaa

SEQ ID NO: 15700 - DNA, 20 bp, Artificial Sequence
  Description of Artificial Sequence: Synthetic oligonucleotide
  Target: AGXT; (-) strand; PAM type: YTN; PAM sequence: CTT
tgaaagacacaattaagaaa

SEQ ID NO: 15701 - DNA, 20 bp, Artificial Sequence
  Description of Artificial Sequence: Synthetic oligonucleotide
  Target: AGXT; (-) strand; PAM type: YTN; PAM sequence: CTC
tttgaaagacacaattaaga

SEQ ID NO: 15702 - DNA, 20 bp, Artificial Sequence
  Description of Artificial Sequence: Synthetic oligonucleotide
  Target: AGXT; (-) strand; PAM type: YTN; PAM sequence: CTG
ctctttgaaagacacaatta

SEQ ID NO: 15703 - DNA, 20 bp, Artificial Sequence
  Description of Artificial Sequence: Synthetic oligonucleotide
  Target: AGXT; (-) strand; PAM type: YTN; PAM sequence: TTG
aaaatacctgctctttgaaa

SEQ ID NO: 15704 - DNA, 20 bp, Artificial Sequence
  Description of Artificial Sequence: Synthetic oligonucleotide
  Target: AGXT; (-) strand; PAM type: YTN; PAM sequence: TTC
accaaaattgaaaatacctg

SEQ ID NO: 15705 - DNA, 20 bp, Artificial Sequence
  Description of Artificial Sequence: Synthetic oligonucleotide
  Target: AGXT; (-) strand; PAM type: YTN; PAM sequence: CTT
caccaaaattgaaaatacct

SEQ ID NO: 15706 - DNA, 20 bp, Artificial Sequence
  Description of Artificial Sequence: Synthetic oligonucleotide
  Target: AGXT; (-) strand; PAM type: YTN; PAM sequence: TTC
ataaatacgacttcaccaaa

SEQ ID NO: 15707 - DNA, 20 bp, Artificial Sequence
  Description of Artificial Sequence: Synthetic oligonucleotide
  Target: AGXT; (-) strand; PAM type: YTN; PAM sequence: CTC
attcataaatacgacttcac

SEQ ID NO: 15708 - DNA, 20 bp, Artificial Sequence
  Description of Artificial Sequence: Synthetic oligonucleotide
  Target: AGXT; (-) strand; PAM type: YTN; PAM sequence: TTA
gacaagatacaaacagccca

SEQ ID NO: 15709 - DNA, 20 bp, Artificial Sequence
  Description of Artificial Sequence: Synthetic oligonucleotide
  Target: AGXT; (-) strand; PAM type: YTN; PAM sequence: CTT
agacaagatacaaacagccc

SEQ ID NO: 15710 - DNA, 20 bp, Artificial Sequence
  Description of Artificial Sequence: Synthetic oligonucleotide
  Target: AGXT; (-) strand; PAM type: YTN; PAM sequence: TTC
ttagacaagatacaaacagc

SEQ ID NO: 15711 - DNA, 20 bp, Artificial Sequence
  Description of Artificial Sequence: Synthetic oligonucleotide
  Target: AGXT; (-) strand; PAM type: YTN; PAM sequence: TTT
cttagacaagatacaaacag

SEQ ID NO: 15712 - DNA, 20 bp, Artificial Sequence
  Description of Artificial Sequence: Synthetic oligonucleotide
  Target: AGXT; (-) strand; PAM type: YTN; PAM sequence: CTC
aaagtaggcaaaggtttctt

SEQ ID NO: 15713 - DNA, 20 bp, Artificial Sequence
  Description of Artificial Sequence: Synthetic oligonucleotide
  Target: AGXT; (-) strand; PAM type: YTN; PAM sequence: CTA
gaagaaaacacaggaagata

SEQ ID NO: 15714 - DNA, 20 bp, Artificial Sequence
  Description of Artificial Sequence: Synthetic oligonucleotide
  Target: AGXT; (-) strand; PAM type: YTN; PAM sequence: TTC
tagaagaaaacacaggaaga

SEQ ID NO: 15715 - DNA, 20 bp, Artificial Sequence
  Description of Artificial Sequence: Synthetic oligonucleotide
  Target: AGXT; (-) strand; PAM type: YTN; PAM sequence: TTT
ctagaagaaaacacaggaag

SEQ ID NO: 15716 - DNA, 20 bp, Artificial Sequence
  Description of Artificial Sequence: Synthetic oligonucleotide
  Target: AGXT; (-) strand; PAM type: YTN; PAM sequence: CTG
taaagtttctagaagaaaac

SEQ ID NO: 15717 - DNA, 20 bp, Artificial Sequence
  Description of Artificial Sequence: Synthetic oligonucleotide
  Target: AGXT; (-) strand; PAM type: YTN; PAM sequence: CTG
acactgtaaagtttctagaa

SEQ ID NO: 15718 - DNA, 20 bp, Artificial Sequence
  Description of Artificial Sequence: Synthetic oligonucleotide
  Target: AGXT; (-) strand; PAM type: YTN; PAM sequence: CTA
aatacaaaagctgacactgt

SEQ ID NO: 15719 - DNA, 20 bp, Artificial Sequence
  Description of Artificial Sequence: Synthetic oligonucleotide
  Target: AGXT; (-) strand; PAM type: YTN; PAM sequence: TTA
atatgaggtgtatcatagac

SEQ ID NO: 15720 - DNA, 20 bp, Artificial Sequence
  Description of Artificial Sequence: Synthetic oligonucleotide
  Target: AGXT; (-) strand; PAM type: YTN; PAM sequence: CTG
tgcacaaaattaatatgagg

SEQ ID NO: 15721 - DNA, 20 bp, Artificial Sequence
  Description of Artificial Sequence: Synthetic oligonucleotide
  Target: AGXT; (-) strand; PAM type: YTN; PAM sequence: CTA
cactgtgcacaaaattaata

SEQ ID NO: 15722 - DNA, 20 bp, Artificial Sequence
  Description of Artificial Sequence: Synthetic oligonucleotide
  Target: AGXT; (-) strand; PAM type: YTN; PAM sequence: TTC
tacactgtgcacaaaattaa

SEQ ID NO: 15723 - DNA, 20 bp, Artificial Sequence
  Description of Artificial Sequence: Synthetic oligonucleotide
  Target: AGXT; (-) strand; PAM type: YTN; PAM sequence: TTT
ctacactgtgcacaaaatta

SEQ ID NO: 15724 - DNA, 20 bp, Artificial Sequence
  Description of Artificial Sequence: Synthetic oligonucleotide
  Target: AGXT; (-) strand; PAM type: YTN; PAM sequence: CTT
tctacactgtgcacaaaatt

SEQ ID NO: 15725 - DNA, 20 bp, Artificial Sequence
  Description of Artificial Sequence: Synthetic oligonucleotide
  Target: AGXT; (-) strand; PAM type: YTN; PAM sequence: TTG
accccctttctacactgtgc

SEQ ID NO: 15726 - DNA, 20 bp, Artificial Sequence
  Description of Artificial Sequence: Synthetic oligonucleotide
  Target: AGXT; (-) strand; PAM type: YTN; PAM sequence: CTT
gaccccctttctacactgtg

SEQ ID NO: 15727 - DNA, 20 bp, Artificial Sequence
  Description of Artificial Sequence: Synthetic oligonucleotide
  Target: AGXT; (-) strand; PAM type: YTN; PAM sequence: CTG
ggatatcagtatggataaaa

SEQ ID NO: 15728 - DNA, 20 bp, Artificial Sequence
  Description of Artificial Sequence: Synthetic oligonucleotide
  Target: AGXT; (-) strand; PAM type: YTN; PAM sequence: CTG
gaactgggatatcagtatgg

SEQ ID NO: 15729 - DNA, 20 bp, Artificial Sequence
  Description of Artificial Sequence: Synthetic oligonucleotide
  Target: AGXT; (-) strand; PAM type: YTN; PAM sequence: TTA
ctggaactgggatatcagta

SEQ ID NO: 15730 - DNA, 20 bp, Artificial Sequence
  Description of Artificial Sequence: Synthetic oligonucleotide
  Target: AGXT; (-) strand; PAM type: YTN; PAM sequence: TTA
acaaacgttactggaactgg

SEQ ID NO: 15731 - DNA, 20 bp, Artificial Sequence
  Description of Artificial Sequence: Synthetic oligonucleotide
  Target: AGXT; (-) strand; PAM type: YTN; PAM sequence: TTT
aacaaacgttactggaactg

SEQ ID NO: 15732 - DNA, 20 bp, Artificial Sequence
  Description of Artificial Sequence: Synthetic oligonucleotide
  Target: AGXT; (-) strand; PAM type: YTN; PAM sequence: CTG
tttaacaaacgttactggaa

SEQ ID NO: 15733 - DNA, 20 bp, Artificial Sequence
  Description of Artificial Sequence: Synthetic oligonucleotide
  Target: AGXT; (-) strand; PAM type: YTN; PAM sequence: TTC
aatggggaaaggaaagtctg

SEQ ID NO: 15734 - DNA, 20 bp, Artificial Sequence
  Description of Artificial Sequence: Synthetic oligonucleotide
  Target: AGXT; (-) strand; PAM type: YTN; PAM sequence: TTG
tcaagtcagttcaatgggga

SEQ ID NO: 15735 - DNA, 20 bp, Artificial Sequence
  Description of Artificial Sequence: Synthetic oligonucleotide
  Target: AGXT; (-) strand; PAM type: YTN; PAM sequence: TTA
acaaagttgtcaagtcagtt

SEQ ID NO: 15736 - DNA, 20 bp, Artificial Sequence
  Description of Artificial Sequence: Synthetic oligonucleotide
  Target: AGXT; (-) strand; PAM type: YTN; PAM sequence: TTT
aacaaagttgtcaagtcagt

SEQ ID NO: 15737 - DNA, 20 bp, Artificial Sequence
  Description of Artificial Sequence: Synthetic oligonucleotide
  Target: AGXT; (-) strand; PAM type: YTN; PAM sequence: TTT
taacaaagttgtcaagtcag

SEQ ID NO: 15738 - DNA, 20 bp, Artificial Sequence
  Description of Artificial Sequence: Synthetic oligonucleotide
  Target: AGXT; (-) strand; PAM type: YTN; PAM sequence: TTT
ttaacaaagttgtcaagtca

SEQ ID NO: 15739 - DNA, 20 bp, Artificial Sequence
  Description of Artificial Sequence: Synthetic oligonucleotide
  Target: AGXT; (-) strand; PAM type: YTN; PAM sequence: CTG
atttttaacaaagttgtcaa

SEQ ID NO: 15740 - DNA, 20 bp, Artificial Sequence
  Description of Artificial Sequence: Synthetic oligonucleotide
  Target: AGXT; (-) strand; PAM type: YTN; PAM sequence: CTA
tgaatgtgtagtcaactgat

SEQ ID NO: 15741 - DNA, 20 bp, Artificial Sequence
  Description of Artificial Sequence: Synthetic oligonucleotide
  Target: AGXT; (-) strand; PAM type: YTN; PAM sequence: CTG
taaatagacctatgaatgtg

SEQ ID NO: 15742 - DNA, 20 bp, Artificial Sequence
  Description of Artificial Sequence: Synthetic oligonucleotide
  Target: AGXT; (-) strand; PAM type: YTN; PAM sequence: TTG
acacgaggatgcaatgaaac

SEQ ID NO: 15743 - DNA, 20 bp, Artificial Sequence
  Description of Artificial Sequence: Synthetic oligonucleotide
  Target: AGXT; (-) strand; PAM type: YTN; PAM sequence: TTG
caacagcatgggattgacac

SEQ ID NO: 15744 - DNA, 20 bp, Artificial Sequence
  Description of Artificial Sequence: Synthetic oligonucleotide
  Target: AGXT; (-) strand; PAM type: YTN; PAM sequence: TTT
gcaacagcatgggattgaca

SEQ ID NO: 15745 - DNA, 20 bp, Artificial Sequence
  Description of Artificial Sequence: Synthetic oligonucleotide
  Target: AGXT; (-) strand; PAM type: YTN; PAM sequence: CTA
caatatttgcaacagcatgg

SEQ ID NO: 15746 - DNA, 20 bp, Artificial Sequence
  Description of Artificial Sequence: Synthetic oligonucleotide
  Target: AGXT; (-) strand; PAM type: YTN; PAM sequence: TTG
taaagctacaatatttgcaa

SEQ ID NO: 15747 - DNA, 20 bp, Artificial Sequence
  Description of Artificial Sequence: Synthetic oligonucleotide
  Target: AGXT; (-) strand; PAM type: YTN; PAM sequence: TTA
ttgtaaagctacaatatttg

SEQ ID NO: 15748 - DNA, 20 bp, Artificial Sequence
  Description of Artificial Sequence: Synthetic oligonucleotide
  Target: AGXT; (-) strand; PAM type: YTN; PAM sequence: TTC
aagagttattgtaaagctac

SEQ ID NO: 15749 - DNA, 20 bp, Artificial Sequence
  Description of Artificial Sequence: Synthetic oligonucleotide
  Target: AGXT; (-) strand; PAM type: YTN; PAM sequence: TTT
caagagttattgtaaagcta

SEQ ID NO: 15750 - DNA, 20 bp, Artificial Sequence
  Description of Artificial Sequence: Synthetic oligonucleotide
  Target: AGXT; (-) strand; PAM type: YTN; PAM sequence: TTA
atttcaagagttattgtaaa

SEQ ID NO: 15751 - DNA, 20 bp, Artificial Sequence
  Description of Artificial Sequence: Synthetic oligonucleotide
  Target: AGXT; (-) strand; PAM type: YTN; PAM sequence: CTT
aatttcaagagttattgtaa

SEQ ID NO: 15752 - DNA, 20 bp, Artificial Sequence
  Description of Artificial Sequence: Synthetic oligonucleotide
  Target: AGXT; (-) strand; PAM type: YTN; PAM sequence: TTC
ttaatttcaagagttattgt

SEQ ID NO: 15753 - DNA, 20 bp, Artificial Sequence
  Description of Artificial Sequence: Synthetic oligonucleotide
  Target: AGXT; (-) strand; PAM type: YTN; PAM sequence: TTG
ttcttaatttcaagagttat

SEQ ID NO: 15754 - DNA, 20 bp, Artificial Sequence
  Description of Artificial Sequence: Synthetic oligonucleotide
  Target: AGXT; (-) strand; PAM type: YTN; PAM sequence: CTT
gttcttaatttcaagagtta

SEQ ID NO: 15755 - DNA, 20 bp, Artificial Sequence
  Description of Artificial Sequence: Synthetic oligonucleotide
  Target: AGXT; (-) strand; PAM type: YTN; PAM sequence: TTG
gaggacttgttcttaatttc

SEQ ID NO: 15756 - DNA, 20 bp, Artificial Sequence
  Description of Artificial Sequence: Synthetic oligonucleotide
  Target: AGXT; (-) strand; PAM type: YTN; PAM sequence: TTA
aaagggagaaaaacattgga

SEQ ID NO: 15757 - DNA, 20 bp, Artificial Sequence
  Description of Artificial Sequence: Synthetic oligonucleotide
  Target: AGXT; (-) strand; PAM type: YTN; PAM sequence: TTT
aaaagggagaaaaacattgg

SEQ ID NO: 15758 - DNA, 20 bp, Artificial Sequence
  Description of Artificial Sequence: Synthetic oligonucleotide
  Target: AGXT; (-) strand; PAM type: YTN; PAM sequence: CTT
taaaagggagaaaaacattg

SEQ ID NO: 15759 - DNA, 20 bp, Artificial Sequence
  Description of Artificial Sequence: Synthetic oligonucleotide
  Target: AGXT; (-) strand; PAM type: YTN; PAM sequence: TTC
aaaggatgtagaatacaaaa

SEQ ID NO: 15760 - DNA, 20 bp, Artificial Sequence
  Description of Artificial Sequence: Synthetic oligonucleotide
  Target: AGXT; (-) strand; PAM type: YTN; PAM sequence: CTA
aaacgtacacagaaattcaa

SEQ ID NO: 15761 - DNA, 20 bp, Artificial Sequence
  Description of Artificial Sequence: Synthetic oligonucleotide
  Target: AGXT; (-) strand; PAM type: YTN; PAM sequence: CTG
aagaaatagacaacatgaat

SEQ ID NO: 15762 - DNA, 20 bp, Artificial Sequence
  Description of Artificial Sequence: Synthetic oligonucleotide
  Target: AGXT; (-) strand; PAM type: YTN; PAM sequence: TTC
tgaagaaatagacaacatga

SEQ ID NO: 15763 - DNA, 20 bp, Artificial Sequence
  Description of Artificial Sequence: Synthetic oligonucleotide
  Target: AGXT; (-) strand; PAM type: YTN; PAM sequence: CTA
ttctgaagaaatagacaaca

SEQ ID NO: 15764 - DNA, 20 bp, Artificial Sequence
  Description of Artificial Sequence: Synthetic oligonucleotide
  Target: AGXT; (-) strand; PAM type: YTN; PAM sequence: TTC
agcaagctattctgaagaaa

SEQ ID NO: 15765 - DNA, 20 bp, Artificial Sequence
  Description of Artificial Sequence: Synthetic oligonucleotide
  Target: AGXT; (-) strand; PAM type: YTN; PAM sequence: TTT
cagcaagctattctgaagaa

SEQ ID NO: 15766 - DNA, 20 bp, Artificial Sequence
  Description of Artificial Sequence: Synthetic oligonucleotide
  Target: AGXT; (-) strand; PAM type: YTN; PAM sequence: CTA
ccaaaatttcagcaagctat

SEQ ID NO: 15767 - DNA, 20 bp, Artificial Sequence
  Description of Artificial Sequence: Synthetic oligonucleotide
  Target: AGXT; (-) strand; PAM type: YTN; PAM sequence: TTC
ctaccaaaatttcagcaagc

SEQ ID NO: 15768 - DNA, 20 bp, Artificial Sequence
  Description of Artificial Sequence: Synthetic oligonucleotide
  Target: AGXT; (-) strand; PAM type: YTN; PAM sequence: TTG
gtgcagttcctaccaaaatt

SEQ ID NO: 15769 - DNA, 20 bp, Artificial Sequence
  Description of Artificial Sequence: Synthetic oligonucleotide
  Target: AGXT; (-) strand; PAM type: YTN; PAM sequence: TTT
ggtgcagttcctaccaaaat

SEQ ID NO: 15770 - DNA, 20 bp, Artificial Sequence
  Description of Artificial Sequence: Synthetic oligonucleotide
  Target: AGXT; (-) strand; PAM type: YTN; PAM sequence: TTG
atatatagatttggtgcagt

SEQ ID NO: 15771 - DNA, 20 bp, Artificial Sequence
  Description of Artificial Sequence: Synthetic oligonucleotide
  Target: AGXT; (-) strand; PAM type: YTN; PAM sequence: CTT
gatatatagatttggtgcag

SEQ ID NO: 15772 - DNA, 20 bp, Artificial Sequence
  Description of Artificial Sequence: Synthetic oligonucleotide
  Target: AGXT; (-) strand; PAM type: YTN; PAM sequence: TTA
acttgatatatagatttggt

SEQ ID NO: 15773 - DNA, 20 bp, Artificial Sequence
  Description of Artificial Sequence: Synthetic oligonucleotide
  Target: AGXT; (-) strand; PAM type: YTN; PAM sequence: CTT
aacttgatatatagatttgg

SEQ ID NO: 15774 - DNA, 20 bp, Artificial Sequence
  Description of Artificial Sequence: Synthetic oligonucleotide
  Target: AGXT; (-) strand; PAM type: YTN; PAM sequence: TTC
cttaacttgatatatagatt

SEQ ID NO: 15775 - DNA, 20 bp, Artificial Sequence
  Description of Artificial Sequence: Synthetic oligonucleotide
  Target: AGXT; (-) strand; PAM type: YTN; PAM sequence: TTT
ccttaacttgatatatagat

SEQ ID NO: 15776 - DNA, 20 bp, Artificial Sequence
  Description of Artificial Sequence: Synthetic oligonucleotide
  Target: AGXT; (-) strand; PAM type: YTN; PAM sequence: TTT
tccttaacttgatatataga

SEQ ID NO: 15777 - DNA, 20 bp, Artificial Sequence
  Description of Artificial Sequence: Synthetic oligonucleotide
  Target: AGXT; (-) strand; PAM type: YTN; PAM sequence: TTC
cattttccttaacttgatat

SEQ ID NO: 15778 - DNA, 20 bp, Artificial Sequence
  Description of Artificial Sequence: Synthetic oligonucleotide
  Target: AGXT; (-) strand; PAM type: YTN; PAM sequence: TTT
ccattttccttaacttgata

SEQ ID NO: 15779 - DNA, 20 bp, Artificial Sequence
  Description of Artificial Sequence: Synthetic oligonucleotide
  Target: AGXT; (-) strand; PAM type: YTN; PAM sequence: TTA
tttccattttccttaacttg

SEQ ID NO: 15780 - DNA, 20 bp, Artificial Sequence
  Description of Artificial Sequence: Synthetic oligonucleotide
  Target: AGXT; (-) strand; PAM type: YTN; PAM sequence: TTT
atttccattttccttaactt

SEQ ID NO: 15781 - DNA, 20 bp, Artificial Sequence
  Description of Artificial Sequence: Synthetic oligonucleotide
  Target: AGXT; (-) strand; PAM type: YTN; PAM sequence: CTT
tatttccattttccttaact

SEQ ID NO: 15782 - DNA, 20 bp, Artificial Sequence
  Description of Artificial Sequence: Synthetic oligonucleotide
  Target: AGXT; (-) strand; PAM type: YTN; PAM sequence: TTA
tactttatttccattttcct

SEQ ID NO: 15783 - DNA, 20 bp, Artificial Sequence
  Description of Artificial Sequence: Synthetic oligonucleotide
  Target: AGXT; (-) strand; PAM type: YTN; PAM sequence: TTT
atactttatttccattttcc

SEQ ID NO: 15784 - DNA, 20 bp, Artificial Sequence
  Description of Artificial Sequence: Synthetic oligonucleotide
  Target: AGXT; (-) strand; PAM type: YTN; PAM sequence: TTG
tgaaatggaatttatacttt

SEQ ID NO: 15785 - DNA, 20 bp, Artificial Sequence
  Description of Artificial Sequence: Synthetic oligonucleotide
  Target: AGXT; (-) strand; PAM type: YTN; PAM sequence: TTT
gtgaaatggaatttatactt

SEQ ID NO: 15786 - DNA, 20 bp, Artificial Sequence
  Description of Artificial Sequence: Synthetic oligonucleotide
  Target: AGXT; (-) strand; PAM type: YTN; PAM sequence: CTG
tttgtgaaatggaatttata

SEQ ID NO: 15787 - DNA, 20 bp, Artificial Sequence
  Description of Artificial Sequence: Synthetic oligonucleotide
  Target: AGXT; (-) strand; PAM type: YTN; PAM sequence: TTC
tgtttgtgaaatggaattta

SEQ ID NO: 15788 - DNA, 20 bp, Artificial Sequence
  Description of Artificial Sequence: Synthetic oligonucleotide
  Target: AGXT; (-) strand; PAM type: YTN; PAM sequence: TTT
ctgtttgtgaaatggaattt

SEQ ID NO: 15789 - DNA, 20 bp, Artificial Sequence
  Description of Artificial Sequence: Synthetic oligonucleotide
  Target: AGXT; (-) strand; PAM type: YTN; PAM sequence: TTA
catttctgtttgtgaaatgg

SEQ ID NO: 15790 - DNA, 20 bp, Artificial Sequence
  Description of Artificial Sequence: Synthetic oligonucleotide
  Target: AGXT; (-) strand; PAM type: YTN; PAM sequence: CTT
acatttctgtttgtgaaatg

SEQ ID NO: 15791 - DNA, 20 bp, Artificial Sequence
  Description of Artificial Sequence: Synthetic oligonucleotide
  Target: AGXT; (-) strand; PAM type: YTN; PAM sequence: TTA
aaatacttacatttctgttt

SEQ ID NO: 15792 - DNA, 20 bp, Artificial Sequence
  Description of Artificial Sequence: Synthetic oligonucleotide
  Target: AGXT; (-) strand; PAM type: YTN; PAM sequence: TTT
aaaatacttacatttctgtt

SEQ ID NO: 15793 - DNA, 20 bp, Artificial Sequence
  Description of Artificial Sequence: Synthetic oligonucleotide
  Target: AGXT; (-) strand; PAM type: YTN; PAM sequence: TTT
taaaatacttacatttctgt

SEQ ID NO: 15794 - DNA, 20 bp, Artificial Sequence
  Description of Artificial Sequence: Synthetic oligonucleotide
  Target: AGXT; (-) strand; PAM type: YTN; PAM sequence: CTG
aaagtaattttaaaatactt

SEQ ID NO: 15795 - DNA, 20 bp, Artificial Sequence
  Description of Artificial Sequence: Synthetic oligonucleotide
  Target: AGXT; (-) strand; PAM type: YTN; PAM sequence: TTG
ctgaaagtaattttaaaata

SEQ ID NO: 15796 - DNA, 20 bp, Artificial Sequence
  Description of Artificial Sequence: Synthetic oligonucleotide
  Target: AGXT; (-) strand; PAM type: YTN; PAM sequence: CTA
gaaacattgctgaaagtaat

SEQ ID NO: 15797 - DNA, 20 bp, Artificial Sequence
  Description of Artificial Sequence: Synthetic oligonucleotide
  Target: AGXT; (-) strand; PAM type: YTN; PAM sequence: TTG
aaaactagaaacattgctga

SEQ ID NO: 15798 - DNA, 20 bp, Artificial Sequence
  Description of Artificial Sequence: Synthetic oligonucleotide
  Target: AGXT; (-) strand; PAM type: YTN; PAM sequence: CTG
tatgttgaaaactagaaaca

SEQ ID NO: 15799 - DNA, 20 bp, Artificial Sequence
  Description of Artificial Sequence: Synthetic oligonucleotide
  Target: AGXT; (-) strand; PAM type: YTN; PAM sequence: TTG
ctgtatgttgaaaactagaa

SEQ ID NO: 15800 - DNA, 20 bp, Artificial Sequence
  Description of Artificial Sequence: Synthetic oligonucleotide
  Target: AGXT; (-) strand; PAM type: YTN; PAM sequence: TTT
gctgtatgttgaaaactaga

SEQ ID NO: 15801 - DNA, 20 bp, Artificial Sequence
  Description of Artificial Sequence: Synthetic oligonucleotide
  Target: AGXT; (-) strand; PAM type: YTN; PAM sequence: CTT
tgctgtatgttgaaaactag

SEQ ID NO: 15802 - DNA, 20 bp, Artificial Sequence
  Description of Artificial Sequence: Synthetic oligonucleotide
  Target: AGXT; (-) strand; PAM type: YTN; PAM sequence: CTC
ccactttgctgtatgttgaa

SEQ ID NO: 15803 - DNA, 20 bp, Artificial Sequence
  Description of Artificial Sequence: Synthetic oligonucleotide
  Target: AGXT; (-) strand; PAM type: YTN; PAM sequence: TTA
aataaccccctcccactttg

SEQ ID NO: 15804 - DNA, 20 bp, Artificial Sequence
  Description of Artificial Sequence: Synthetic oligonucleotide
  Target: AGXT; (-) strand; PAM type: YTN; PAM sequence: CTT
aaataaccccctcccacttt

SEQ ID NO: 15805 - DNA, 20 bp, Artificial Sequence
  Description of Artificial Sequence: Synthetic oligonucleotide
  Target: AGXT; (-) strand; PAM type: YTN; PAM sequence: TTC
cttaaataaccccctcccac

SEQ ID NO: 15806 - DNA, 20 bp, Artificial Sequence
  Description of Artificial Sequence: Synthetic oligonucleotide
  Target: AGXT; (-) strand; PAM type: YTN; PAM sequence: TTT
ccttaaataaccccctccca

SEQ ID NO: 15807 - DNA, 20 bp, Artificial Sequence
  Description of Artificial Sequence: Synthetic oligonucleotide
  Target: AGXT; (-) strand; PAM type: YTN; PAM sequence: CTT
tccttaaataaccccctccc

SEQ ID NO: 15808 - DNA, 20 bp, Artificial Sequence
  Description of Artificial Sequence: Synthetic oligonucleotide
  Target: AGXT; (-) strand; PAM type: YTN; PAM sequence: CTG
gctttccttaaataaccccc

SEQ ID NO: 15809 - DNA, 20 bp, Artificial Sequence
  Description of Artificial Sequence: Synthetic oligonucleotide
  Target: AGXT; (-) strand; PAM type: YTN; PAM sequence: TTC
ctggctttccttaaataacc

SEQ ID NO: 15810 - DNA, 20 bp, Artificial Sequence
  Description of Artificial Sequence: Synthetic oligonucleotide
  Target: AGXT; (-) strand; PAM type: YTN; PAM sequence: CTG
ggttcctggctttccttaaa

SEQ ID NO: 15811 - DNA, 20 bp, Artificial Sequence
  Description of Artificial Sequence: Synthetic oligonucleotide
  Target: AGXT; (-) strand; PAM type: YTN; PAM sequence: TTC
ctgggttcctggctttcctt

SEQ ID NO: 15812 - DNA, 20 bp, Artificial Sequence
  Description of Artificial Sequence: Synthetic oligonucleotide
  Target: AGXT; (-) strand; PAM type: YTN; PAM sequence: CTG
ttcctgggttcctggctttc

SEQ ID NO: 15813 - DNA, 20 bp, Artificial Sequence
  Description of Artificial Sequence: Synthetic oligonucleotide
  Target: AGXT; (-) strand; PAM type: YTN; PAM sequence: TTC
ctgttcctgggttcctggct

SEQ ID NO: 15814 - DNA, 20 bp, Artificial Sequence
  Description of Artificial Sequence: Synthetic oligonucleotide
  Target: AGXT; (-) strand; PAM type: YTN; PAM sequence: TTT
cctgttcctgggttcctggc

SEQ ID NO: 15815 - DNA, 20 bp, Artificial Sequence
  Description of Artificial Sequence: Synthetic oligonucleotide
  Target: AGXT; (-) strand; PAM type: YTN; PAM sequence: CTT
tcctgttcctgggttcctgg

SEQ ID NO: 15816 - DNA, 20 bp, Artificial Sequence
  Description of Artificial Sequence: Synthetic oligonucleotide
  Target: AGXT; (-) strand; PAM type: YTN; PAM sequence: CTG
gatcagtggctttcctgttc

SEQ ID NO: 15817 - DNA, 20 bp, Artificial Sequence
  Description of Artificial Sequence: Synthetic oligonucleotide
  Target: AGXT; (-) strand; PAM type: YTN; PAM sequence: CTG
ggctggatcagtggctttcc

SEQ ID NO: 15818 - DNA, 20 bp, Artificial Sequence
  Description of Artificial Sequence: Synthetic oligonucleotide
  Target: AGXT; (-) strand; PAM type: YTN; PAM sequence: CTC
ctgggctggatcagtggctt

SEQ ID NO: 15819 - DNA, 20 bp, Artificial Sequence
  Description of Artificial Sequence: Synthetic oligonucleotide
  Target: AGXT; (-) strand; PAM type: YTN; PAM sequence: CTG
cctcctgggctggatcagtg

SEQ ID NO: 15820 - DNA, 20 bp, Artificial Sequence
  Description of Artificial Sequence: Synthetic oligonucleotide
  Target: AGXT; (-) strand; PAM type: YTN; PAM sequence: CTG
gtcctgcctcctgggctgga

SEQ ID NO: 15821 - DNA, 20 bp, Artificial Sequence
  Description of Artificial Sequence: Synthetic oligonucleotide
  Target: AGXT; (-) strand; PAM type: YTN; PAM sequence: CTG
cctggtcctgcctcctgggc

SEQ ID NO: 15822 - DNA, 20 bp, Artificial Sequence
  Description of Artificial Sequence: Synthetic oligonucleotide
  Target: AGXT; (-) strand; PAM type: YTN; PAM sequence: CTG
ggggccggggaggctgcctg

SEQ ID NO: 15823 - DNA, 20 bp, Artificial Sequence
  Description of Artificial Sequence: Synthetic oligonucleotide
  Target: AGXT; (-) strand; PAM type: YTN; PAM sequence: TTG
gagggagaagggccgctggg

SEQ ID NO: 15824 - DNA, 20 bp, Artificial Sequence
  Description of Artificial Sequence: Synthetic oligonucleotide
  Target: AGXT; (-) strand; PAM type: YTN; PAM sequence: CTT
ggagggagaagggccgctgg

SEQ ID NO: 15825 - DNA, 20 bp, Artificial Sequence
  Description of Artificial Sequence: Synthetic oligonucleotide
  Target: AGXT; (-) strand; PAM type: YTN; PAM sequence: CTA
cttggagggagaagggccgc

SEQ ID NO: 15826 - DNA, 20 bp, Artificial Sequence
  Description of Artificial Sequence: Synthetic oligonucleotide
  Target: AGXT; (-) strand; PAM type: YTN; PAM sequence: TTC
tacttggagggagaagggcc

SEQ ID NO: 15827 - DNA, 20 bp, Artificial Sequence
  Description of Artificial Sequence: Synthetic oligonucleotide
  Target: AGXT; (-) strand; PAM type: YTN; PAM sequence: TTC
caggaggttctacttggagg

SEQ ID NO: 15828 - DNA, 20 bp, Artificial Sequence
  Description of Artificial Sequence: Synthetic oligonucleotide
  Target: AGXT; (-) strand; PAM type: YTN; PAM sequence: TTT
ccaggaggttctacttggag

SEQ ID NO: 15829 - DNA, 20 bp, Artificial Sequence
  Description of Artificial Sequence: Synthetic oligonucleotide
  Target: AGXT; (-) strand; PAM type: YTN; PAM sequence: CTG
tttccaggaggttctacttg

SEQ ID NO: 15830 - DNA, 20 bp, Artificial Sequence
  Description of Artificial Sequence: Synthetic oligonucleotide
  Target: AGXT; (-) strand; PAM type: YTN; PAM sequence: CTA
cgcccaagtgggctgtttcc

SEQ ID NO: 15831 - DNA, 20 bp, Artificial Sequence
  Description of Artificial Sequence: Synthetic oligonucleotide
  Target: AGXT; (-) strand; PAM type: YTN; PAM sequence: CTA
acaaaagatctacgcccaag

SEQ ID NO: 15832 - DNA, 20 bp, Artificial Sequence
  Description of Artificial Sequence: Synthetic oligonucleotide
  Target: AGXT; (-) strand; PAM type: YTN; PAM sequence: CTA
ggaataaatctaacaaaaga

SEQ ID NO: 15833 - DNA, 20 bp, Artificial Sequence
  Description of Artificial Sequence: Synthetic oligonucleotide
  Target: AGXT; (-) strand; PAM type: YTN; PAM sequence: TTA
taacagcatcaacaagatca

SEQ ID NO: 15834 - DNA, 20 bp, Artificial Sequence
  Description of Artificial Sequence: Synthetic oligonucleotide
  Target: AGXT; (-) strand; PAM type: YTN; PAM sequence: TTT
ataacagcatcaacaagatc

SEQ ID NO: 15835 - DNA, 20 bp, Artificial Sequence
  Description of Artificial Sequence: Synthetic oligonucleotide
  Target: AGXT; (-) strand; PAM type: YTN; PAM sequence: TTC
aaatgccatttataacagca

SEQ ID NO: 15836 - DNA, 20 bp, Artificial Sequence
  Description of Artificial Sequence: Synthetic oligonucleotide
  Target: AGXT; (-) strand; PAM type: YTN; PAM sequence: TTT
caaatgccatttataacagc

SEQ ID NO: 15837 - DNA, 20 bp, Artificial Sequence
  Description of Artificial Sequence: Synthetic oligonucleotide
  Target: AGXT; (-) strand; PAM type: YTN; PAM sequence: TTT
tcaaatgccatttataacag

SEQ ID NO: 15838 - DNA, 20 bp, Artificial Sequence
  Description of Artificial Sequence: Synthetic oligonucleotide
  Target: AGXT; (-) strand; PAM type: YTN; PAM sequence: CTG
gaaatgaaaattttcaaatg

SEQ ID NO: 15839 - DNA, 20 bp, Artificial Sequence
  Description of Artificial Sequence: Synthetic oligonucleotide
  Target: AGXT; (-) strand; PAM type: YTN; PAM sequence: TTA
aaaaataaacaactggaaat

SEQ ID NO: 15840 - DNA, 20 bp, Artificial Sequence
  Description of Artificial Sequence: Synthetic oligonucleotide
  Target: AGXT; (-) strand; PAM type: YTN; PAM sequence: TTA
tatattaaaaaataaacaac

SEQ ID NO: 15841 - DNA, 20 bp, Artificial Sequence
  Description of Artificial Sequence: Synthetic oligonucleotide
  Target: AGXT; (-) strand; PAM type: YTN; PAM sequence: TTA
atatagaaaaaaatgagatt

SEQ ID NO: 15842 - DNA, 20 bp, Artificial Sequence
  Description of Artificial Sequence: Synthetic oligonucleotide
  Target: AGXT; (-) strand; PAM type: YTN; PAM sequence: TTA
ggaaggtcagaagatacaaa

SEQ ID NO: 15843 - DNA, 20 bp, Artificial Sequence
  Description of Artificial Sequence: Synthetic oligonucleotide
  Target: AGXT; (-) strand; PAM type: YTN; PAM sequence: TTT
aggaaggtcagaagatacaa

SEQ ID NO: 15844 - DNA, 20 bp, Artificial Sequence
  Description of Artificial Sequence: Synthetic oligonucleotide
  Target: AGXT; (-) strand; PAM type: YTN; PAM sequence: TTG
tgaatttaggaaggtcagaa

SEQ ID NO: 15845 - DNA, 20 bp, Artificial Sequence
  Description of Artificial Sequence: Synthetic oligonucleotide
  Target: AGXT; (-) strand; PAM type: YTN; PAM sequence: CTT
gtgaatttaggaaggtcaga

SEQ ID NO: 15846 - DNA, 20 bp, Artificial Sequence
  Description of Artificial Sequence: Synthetic oligonucleotide
  Target: AGXT; (-) strand; PAM type: YTN; PAM sequence: CTA
ggccttgtgaatttaggaag

SEQ ID NO: 15847 - DNA, 20 bp, Artificial Sequence
  Description of Artificial Sequence: Synthetic oligonucleotide
  Target: AGXT; (-) strand; PAM type: YTN; PAM sequence: CTA
ctaggccttgtgaatttagg

SEQ ID NO: 15848 - DNA, 20 bp, Artificial Sequence
  Description of Artificial Sequence: Synthetic oligonucleotide
  Target: AGXT; (-) strand; PAM type: YTN; PAM sequence: CTA
caaagaagctactaggcctt

SEQ ID NO: 15849 - DNA, 20 bp, Artificial Sequence
  Description of Artificial Sequence: Synthetic oligonucleotide
  Target: AGXT; (-) strand; PAM type: YTN; PAM sequence: TTA
aaggaatctacaaagaagct

SEQ ID NO: 15850 - DNA, 20 bp, Artificial Sequence
  Description of Artificial Sequence: Synthetic oligonucleotide
  Target: AGXT; (-) strand; PAM type: YTN; PAM sequence: TTT
aaaggaatctacaaagaagc

SEQ ID NO: 15851 - DNA, 20 bp, Artificial Sequence
  Description of Artificial Sequence: Synthetic oligonucleotide
  Target: AGXT; (-) strand; PAM type: YTN; PAM sequence: TTA
gaaaatttaaaggaatctac

SEQ ID NO: 15852 - DNA, 20 bp, Artificial Sequence
  Description of Artificial Sequence: Synthetic oligonucleotide
  Target: AGXT; (-) strand; PAM type: YTN; PAM sequence: CTT
agaaaatttaaaggaatcta

SEQ ID NO: 15853 - DNA, 20 bp, Artificial Sequence
  Description of Artificial Sequence: Synthetic oligonucleotide
  Target: AGXT; (-) strand; PAM type: YTN; PAM sequence: CTA
cttagaaaatttaaaggaat

SEQ ID NO: 15854 - DNA, 20 bp, Artificial Sequence
  Description of Artificial Sequence: Synthetic oligonucleotide
  Target: AGXT; (-) strand; PAM type: YTN; PAM sequence: TTA
tctacttagaaaatttaaag

SEQ ID NO: 15855 - DNA, 20 bp, Artificial Sequence
  Description of Artificial Sequence: Synthetic oligonucleotide
  Target: AGXT; (-) strand; PAM type: YTN; PAM sequence: TTG
attatctacttagaaaattt

SEQ ID NO: 15856 - DNA, 20 bp, Artificial Sequence
  Description of Artificial Sequence: Synthetic oligonucleotide
  Target: AGXT; (-) strand; PAM type: YTN; PAM sequence: TTT
gattatctacttagaaaatt

SEQ ID NO: 15857 - DNA, 20 bp, Artificial Sequence
  Description of Artificial Sequence: Synthetic oligonucleotide
  Target: AGXT; (-) strand; PAM type: YTN; PAM sequence: TTA
gtcacagagagtttgattat

SEQ ID NO: 15858 - DNA, 20 bp, Artificial Sequence
  Description of Artificial Sequence: Synthetic oligonucleotide
  Target: AGXT; (-) strand; PAM type: YTN; PAM sequence: CTC
attagtcacagagagtttga

SEQ ID NO: 15859 - DNA, 20 bp, Artificial Sequence
  Description of Artificial Sequence: Synthetic oligonucleotide
  Target: AGXT; (-) strand; PAM type: YTN; PAM sequence: CTC
tcattagtcacagagagttt

SEQ ID NO: 15860 - DNA, 20 bp, Artificial Sequence
  Description of Artificial Sequence: Synthetic oligonucleotide
  Target: AGXT; (-) strand; PAM type: YTN; PAM sequence: TTG
caatgaagcaagaaaaagta

SEQ ID NO: 15861 - DNA, 20 bp, Artificial Sequence
  Description of Artificial Sequence: Synthetic oligonucleotide
  Target: AGXT; (-) strand; PAM type: YTN; PAM sequence: CTA
caccgttgcaatgaagcaag

SEQ ID NO: 15862 - DNA, 20 bp, Artificial Sequence
  Description of Artificial Sequence: Synthetic oligonucleotide
  Target: AGXT; (-) strand; PAM type: YTN; PAM sequence: TTG
tggcctacaccgttgcaatg

SEQ ID NO: 15863 - DNA, 20 bp, Artificial Sequence
  Description of Artificial Sequence: Synthetic oligonucleotide
  Target: AGXT; (-) strand; PAM type: YTN; PAM sequence: TTT
gtggcctacaccgttgcaat

SEQ ID NO: 15864 - DNA, 20 bp, Artificial Sequence
  Description of Artificial Sequence: Synthetic oligonucleotide
  Target: AGXT; (-) strand; PAM type: YTN; PAM sequence: CTG
tatttgtggcctacaccgtt

SEQ ID NO: 15865 - DNA, 20 bp, Artificial Sequence
  Description of Artificial Sequence: Synthetic oligonucleotide
  Target: AGXT; (-) strand; PAM type: YTN; PAM sequence: TTC
agcactgtatttgtggccta

SEQ ID NO: 15866 - DNA, 20 bp, Artificial Sequence
  Description of Artificial Sequence: Synthetic oligonucleotide
  Target: AGXT; (-) strand; PAM type: YTN; PAM sequence: CTG
agattcagcactgtatttgt

SEQ ID NO: 15867 - DNA, 20 bp, Artificial Sequence
  Description of Artificial Sequence: Synthetic oligonucleotide
  Target: AGXT; (-) strand; PAM type: YTN; PAM sequence: CTC
atcactgagattcagcactg

SEQ ID NO: 15868 - DNA, 20 bp, Artificial Sequence
  Description of Artificial Sequence: Synthetic oligonucleotide
  Target: AGXT; (-) strand; PAM type: YTN; PAM sequence: CTC
caaggcgagaaggtgcacac

SEQ ID NO: 15869 - DNA, 20 bp, Artificial Sequence
  Description of Artificial Sequence: Synthetic oligonucleotide
  Target: AGXT; (-) strand; PAM type: YTN; PAM sequence: TTA
aacacgtctccaaggcgaga

SEQ ID NO: 15870 - DNA, 20 bp, Artificial Sequence
  Description of Artificial Sequence: Synthetic oligonucleotide
  Target: AGXT; (-) strand; PAM type: YTN; PAM sequence: CTG
agacattaaacacgtctcca

SEQ ID NO: 15871 - DNA, 20 bp, Artificial Sequence
  Description of Artificial Sequence: Synthetic oligonucleotide
  Target: AGXT; (-) strand; PAM type: YTN; PAM sequence: CTG
acgctgagacattaaacacg

SEQ ID NO: 15872 - DNA, 20 bp, Artificial Sequence
  Description of Artificial Sequence: Synthetic oligonucleotide
  Target: AGXT; (-) strand; PAM type: YTN; PAM sequence: CTG
ccgtcagcctgacgctgaga

SEQ ID NO: 15873 - DNA, 20 bp, Artificial Sequence
  Description of Artificial Sequence: Synthetic oligonucleotide
  Target: AGXT; (-) strand; PAM type: YTN; PAM sequence: CTG
ctgccgtcagcctgacgctg

SEQ ID NO: 15874 - DNA, 20 bp, Artificial Sequence
  Description of Artificial Sequence: Synthetic oligonucleotide
  Target: AGXT; (-) strand; PAM type: YTN; PAM sequence: CTG
cagaaaccccactgctgccg

SEQ ID NO: 15875 - DNA, 20 bp, Artificial Sequence
  Description of Artificial Sequence: Synthetic oligonucleotide
  Target: AGXT; (-) strand; PAM type: YTN; PAM sequence: CTG
tgagagcagggcagctgcag

SEQ ID NO: 15876 - DNA, 20 bp, Artificial Sequence
  Description of Artificial Sequence: Synthetic oligonucleotide
  Target: AGXT; (-) strand; PAM type: YTN; PAM sequence: CTG
cctgtgagagcagggcagct

SEQ ID NO: 15877 - DNA, 20 bp, Artificial Sequence
  Description of Artificial Sequence: Synthetic oligonucleotide
  Target: AGXT; (-) strand; PAM type: YTN; PAM sequence: TTC
ctgcctgtgagagcagggca

SEQ ID NO: 15878 - DNA, 20 bp, Artificial Sequence
  Description of Artificial Sequence: Synthetic oligonucleotide
  Target: AGXT; (-) strand; PAM type: YTN; PAM sequence: CTT
cctgcctgtgagagcagggc

SEQ ID NO: 15879 - DNA, 20 bp, Artificial Sequence
  Description of Artificial Sequence: Synthetic oligonucleotide
  Target: AGXT; (-) strand; PAM type: YTN; PAM sequence: CTA
ggacaggtggggacttcctg

SEQ ID NO: 15880 - DNA, 20 bp, Artificial Sequence
  Description of Artificial Sequence: Synthetic oligonucleotide
  Target: AGXT; (-) strand; PAM type: YTN; PAM sequence: CTG
caaactaggacaggtgggga

SEQ ID NO: 15881 - DNA, 20 bp, Artificial Sequence
  Description of Artificial Sequence: Synthetic oligonucleotide
  Target: AGXT; (-) strand; PAM type: YTN; PAM sequence: CTC
tgcaaactaggacaggtggg

SEQ ID NO: 15882 - DNA, 20 bp, Artificial Sequence
  Description of Artificial Sequence: Synthetic oligonucleotide
  Target: AGXT; (-) strand; PAM type: YTN; PAM sequence: TTA
gtgataaataccctctgcaa

SEQ ID NO: 15883 - DNA, 20 bp, Artificial Sequence
  Description of Artificial Sequence: Synthetic oligonucleotide
  Target: AGXT; (-) strand; PAM type: YTN; PAM sequence: CTG
ttagtgataaataccctctg

SEQ ID NO: 15884 - DNA, 20 bp, Artificial Sequence
  Description of Artificial Sequence: Synthetic oligonucleotide
  Target: AGXT; (-) strand; PAM type: YTN; PAM sequence: TTG
acaaaatacaacagctgtta

SEQ ID NO: 15885 - DNA, 20 bp, Artificial Sequence
  Description of Artificial Sequence: Synthetic oligonucleotide
  Target: AGXT; (-) strand; PAM type: YTN; PAM sequence: TTT
gacaaaatacaacagctgtt

SEQ ID NO: 15886 - DNA, 20 bp, Artificial Sequence
  Description of Artificial Sequence: Synthetic oligonucleotide
  Target: AGXT; (-) strand; PAM type: YTN; PAM sequence: CTC
accataggcagaaaaggtat

SEQ ID NO: 15887 - DNA, 20 bp, Artificial Sequence
  Description of Artificial Sequence: Synthetic oligonucleotide
  Target: AGXT; (-) strand; PAM type: YTN; PAM sequence: TTA
tgatcatctcaccataggca

SEQ ID NO: 15888 - DNA, 20 bp, Artificial Sequence
  Description of Artificial Sequence: Synthetic oligonucleotide
  Target: AGXT; (-) strand; PAM type: YTN; PAM sequence: TTT
atgatcatctcaccataggc

SEQ ID NO: 15889 - DNA, 20 bp, Artificial Sequence
  Description of Artificial Sequence: Synthetic oligonucleotide
  Target: AGXT; (-) strand; PAM type: YTN; PAM sequence: CTT
tatgatcatctcaccatagg

SEQ ID NO: 15890 - DNA, 20 bp, Artificial Sequence
  Description of Artificial Sequence: Synthetic oligonucleotide
  Target: AGXT; (-) strand; PAM type: YTN; PAM sequence: TTA
cgagaaaataagaggtcagt

SEQ ID NO: 15891 - DNA, 20 bp, Artificial Sequence
  Description of Artificial Sequence: Synthetic oligonucleotide
  Target: AGXT; (-) strand; PAM type: YTN; PAM sequence: CTG
acaaatatattacgagaaaa

SEQ ID NO: 15892 - DNA, 20 bp, Artificial Sequence
  Description of Artificial Sequence: Synthetic oligonucleotide
  Target: AGXT; (-) strand; PAM type: YTN; PAM sequence: CTA
tcaaaacctgacaaatatat

SEQ ID NO: 15893 - DNA, 20 bp, Artificial Sequence
  Description of Artificial Sequence: Synthetic oligonucleotide
  Target: AGXT; (-) strand; PAM type: YTN; PAM sequence: TTG
ctatcaaaacctgacaaata

SEQ ID NO: 15894 - DNA, 20 bp, Artificial Sequence
  Description of Artificial Sequence: Synthetic oligonucleotide
  Target: AGXT; (-) strand; PAM type: YTN; PAM sequence: CTT
gctatcaaaacctgacaaat

SEQ ID NO: 15895 - DNA, 20 bp, Artificial Sequence
  Description of Artificial Sequence: Synthetic oligonucleotide
  Target: AGXT; (-) strand; PAM type: YTN; PAM sequence: TTA
caagaccaatgtaaccttgc

SEQ ID NO: 15896 - DNA, 20 bp, Artificial Sequence
  Description of Artificial Sequence: Synthetic oligonucleotide
  Target: AGXT; (-) strand; PAM type: YTN; PAM sequence: TTT
acaagaccaatgtaaccttg

SEQ ID NO: 15897 - DNA, 20 bp, Artificial Sequence
  Description of Artificial Sequence: Synthetic oligonucleotide
  Target: AGXT; (-) strand; PAM type: YTN; PAM sequence: CTT
tacaagaccaatgtaacctt

SEQ ID NO: 15898 - DNA, 20 bp, Artificial Sequence
  Description of Artificial Sequence: Synthetic oligonucleotide
  Target: AGXT; (-) strand; PAM type: YTN; PAM sequence: CTG
tccaaaccactttacaagac

SEQ ID NO: 15899 - DNA, 20 bp, Artificial Sequence
  Description of Artificial Sequence: Synthetic oligonucleotide
  Target: AGXT; (-) strand; PAM type: YTN; PAM sequence: TTG
ataaataaaggaaaagaaaa

SEQ ID NO: 15900 - DNA, 20 bp, Artificial Sequence
  Description of Artificial Sequence: Synthetic oligonucleotide
  Target: AGXT; (-) strand; PAM type: YTN; PAM sequence: TTA
attgataaataaaggaaaag

SEQ ID NO: 15901 - DNA, 20 bp, Artificial Sequence
  Description of Artificial Sequence: Synthetic oligonucleotide
  Target: AGXT; (-) strand; PAM type: YTN; PAM sequence: TTT
aattgataaataaaggaaaa

SEQ ID NO: 15902 - DNA, 20 bp, Artificial Sequence
  Description of Artificial Sequence: Synthetic oligonucleotide
  Target: AGXT; (-) strand; PAM type: YTN; PAM sequence: CTA
gacaaatttaattgataaat

SEQ ID NO: 15903 - DNA, 20 bp, Artificial Sequence
  Description of Artificial Sequence: Synthetic oligonucleotide
  Target: AGXT; (-) strand; PAM type: YTN; PAM sequence: TTC
tagacaaatttaattgataa

SEQ ID NO: 15904 - DNA, 20 bp, Artificial Sequence
  Description of Artificial Sequence: Synthetic oligonucleotide
  Target: AGXT; (-) strand; PAM type: YTN; PAM sequence: CTA
ttctagacaaatttaattga

SEQ ID NO: 15905 - DNA, 20 bp, Artificial Sequence
  Description of Artificial Sequence: Synthetic oligonucleotide
  Target: AGXT; (-) strand; PAM type: YTN; PAM sequence: CTA
ccaaaatataaggaaaaaaa

SEQ ID NO: 15906 - DNA, 20 bp, Artificial Sequence
  Description of Artificial Sequence: Synthetic oligonucleotide
  Target: AGXT; (-) strand; PAM type: YTN; PAM sequence: TTC
taccaaaatataaggaaaaa

SEQ ID NO: 15907 - DNA, 20 bp, Artificial Sequence
  Description of Artificial Sequence: Synthetic oligonucleotide
  Target: AGXT; (-) strand; PAM type: YTN; PAM sequence: CTG
gacaattctaccaaaatata

SEQ ID NO: 15908 - DNA, 20 bp, Artificial Sequence
  Description of Artificial Sequence: Synthetic oligonucleotide
  Target: AGXT; (-) strand; PAM type: YTN; PAM sequence: TTC
actggacaattctaccaaaa

SEQ ID NO: 15909 - DNA, 20 bp, Artificial Sequence
  Description of Artificial Sequence: Synthetic oligonucleotide
  Target: AGXT; (-) strand; PAM type: YTN; PAM sequence: CTT
cactggacaattctaccaaa

SEQ ID NO: 15910 - DNA, 20 bp, Artificial Sequence
  Description of Artificial Sequence: Synthetic oligonucleotide
  Target: AGXT; (-) strand; PAM type: YTN; PAM sequence: CTG
tcccataaagcttcactgga

SEQ ID NO: 15911 - DNA, 20 bp, Artificial Sequence
  Description of Artificial Sequence: Synthetic oligonucleotide
  Target: AGXT; (-) strand; PAM type: YTN; PAM sequence: CTC
ctgtcccataaagcttcact

SEQ ID NO: 15912 - DNA, 20 bp, Artificial Sequence
  Description of Artificial Sequence: Synthetic oligonucleotide
  Target: AGXT; (-) strand; PAM type: YTN; PAM sequence: TTC
ccataaagaaagctcctgtc

SEQ ID NO: 15913 - DNA, 20 bp, Artificial Sequence
  Description of Artificial Sequence: Synthetic oligonucleotide
  Target: AGXT; (-) strand; PAM type: YTN; PAM sequence: CTT
cccataaagaaagctcctgt

SEQ ID NO: 15914 - DNA, 20 bp, Artificial Sequence
  Description of Artificial Sequence: Synthetic oligonucleotide
  Target: AGXT; (-) strand; PAM type: YTN; PAM sequence: TTA
aaaaaatccttcccataaag

SEQ ID NO: 15915 - DNA, 20 bp, Artificial Sequence
  Description of Artificial Sequence: Synthetic oligonucleotide
  Target: AGXT; (-) strand; PAM type: YTN; PAM sequence: TTA
gaagtcattaaaaaaatcct

SEQ ID NO: 15916 - DNA, 20 bp, Artificial Sequence
  Description of Artificial Sequence: Synthetic oligonucleotide
  Target: AGXT; (-) strand; PAM type: YTN; PAM sequence: CTA
tgaaaacattagaagtcatt

SEQ ID NO: 15917 - DNA, 20 bp, Artificial Sequence
  Description of Artificial Sequence: Synthetic oligonucleotide
  Target: AGXT; (-) strand; PAM type: YTN; PAM sequence: CTA
tgtctatgaaaacattagaa

SEQ ID NO: 15918 - DNA, 20 bp, Artificial Sequence
  Description of Artificial Sequence: Synthetic oligonucleotide
  Target: AGXT; (-) strand; PAM type: YTN; PAM sequence: CTC
tatgtctatgaaaacattag

SEQ ID NO: 15919 - DNA, 20 bp, Artificial Sequence
  Description of Artificial Sequence: Synthetic oligonucleotide
  Target: AGXT; (-) strand; PAM type: YTN; PAM sequence: CTA
aagaactctatgtctatgaa

SEQ ID NO: 15920 - DNA, 20 bp, Artificial Sequence
  Description of Artificial Sequence: Synthetic oligonucleotide
  Target: AGXT; (-) strand; PAM type: YTN; PAM sequence: TTA
ccaaaacgggcacaaagaga

SEQ ID NO: 15921 - DNA, 20 bp, Artificial Sequence
  Description of Artificial Sequence: Synthetic oligonucleotide
  Target: AGXT; (-) strand; PAM type: YTN; PAM sequence: CTG
ggtaacacaaattaccaaaa

SEQ ID NO: 15922 - DNA, 20 bp, Artificial Sequence
  Description of Artificial Sequence: Synthetic oligonucleotide
  Target: AGXT; (-) strand; PAM type: YTN; PAM sequence: CTC
tgggtaacacaaattaccaa

SEQ ID NO: 15923 - DNA, 20 bp, Artificial Sequence
  Description of Artificial Sequence: Synthetic oligonucleotide
  Target: AGXT; (-) strand; PAM type: YTN; PAM sequence: TTG
gaatcaagcatgctctgggt

SEQ ID NO: 15924 - DNA, 20 bp, Artificial Sequence
  Description of Artificial Sequence: Synthetic oligonucleotide
  Target: AGXT; (-) strand; PAM type: YTN; PAM sequence: CTT
ggaatcaagcatgctctggg

SEQ ID NO: 15925 - DNA, 20 bp, Artificial Sequence
  Description of Artificial Sequence: Synthetic oligonucleotide
  Target: AGXT; (-) strand; PAM type: YTN; PAM sequence: TTC
aacaacttggaatcaagcat

SEQ ID NO: 15926 - DNA, 20 bp, Artificial Sequence
  Description of Artificial Sequence: Synthetic oligonucleotide
  Target: AGXT; (-) strand; PAM type: YTN; PAM sequence: TTA
tgccaacacattcaacaact

SEQ ID NO: 15927 - DNA, 20 bp, Artificial Sequence
  Description of Artificial Sequence: Synthetic oligonucleotide
  Target: AGXT; (-) strand; PAM type: YTN; PAM sequence: TTT
atgccaacacattcaacaac

SEQ ID NO: 15928 - DNA, 20 bp, Artificial Sequence
  Description of Artificial Sequence: Synthetic oligonucleotide
  Target: AGXT; (-) strand; PAM type: YTN; PAM sequence: TTT
tatgccaacacattcaacaa

SEQ ID NO: 15929 - DNA, 20 bp, Artificial Sequence
  Description of Artificial Sequence: Synthetic oligonucleotide
  Target: AGXT; (-) strand; PAM type: YTN; PAM sequence: TTA
tggatgattttatgccaaca

SEQ ID NO: 15930 - DNA, 20 bp, Artificial Sequence
  Description of Artificial Sequence: Synthetic oligonucleotide
  Target: AGXT; (-) strand; PAM type: YTN; PAM sequence: TTA
aaggataataaagggatatt

SEQ ID NO: 15931 - DNA, 20 bp, Artificial Sequence
  Description of Artificial Sequence: Synthetic oligonucleotide
  Target: AGXT; (-) strand; PAM type: YTN; PAM sequence: TTA
ccaataccaggaatgaaaca

SEQ ID NO: 15932 - DNA, 20 bp, Artificial Sequence
  Description of Artificial Sequence: Synthetic oligonucleotide
  Target: AGXT; (-) strand; PAM type: YTN; PAM sequence: CTG
atcaatgggagaaaaaaaag

SEQ ID NO: 15933 - DNA, 20 bp, Artificial Sequence
  Description of Artificial Sequence: Synthetic oligonucleotide
  Target: AGXT; (-) strand; PAM type: YTN; PAM sequence: CTA
gcaagactgatcaatgggag

SEQ ID NO: 15934 - DNA, 20 bp, Artificial Sequence
  Description of Artificial Sequence: Synthetic oligonucleotide
  Target: AGXT; (-) strand; PAM type: YTN; PAM sequence: CTA
ataaaatcagtaacccccta

SEQ ID NO: 15935 - DNA, 20 bp, Artificial Sequence
  Description of Artificial Sequence: Synthetic oligonucleotide
  Target: AGXT; (-) strand; PAM type: YTN; PAM sequence: TTG
gagagactaataaaatcagt

SEQ ID NO: 15936 - DNA, 20 bp, Artificial Sequence
  Description of Artificial Sequence: Synthetic oligonucleotide
  Target: AGXT; (-) strand; PAM type: YTN; PAM sequence: TTT
ggagagactaataaaatcag

SEQ ID NO: 15937 - DNA, 20 bp, Artificial Sequence
  Description of Artificial Sequence: Synthetic oligonucleotide
  Target: AGXT; (-) strand; PAM type: YTN; PAM sequence: TTT
tggagagactaataaaatca

SEQ ID NO: 15938 - DNA, 20 bp, Artificial Sequence
  Description of Artificial Sequence: Synthetic oligonucleotide
  Target: AGXT; (-) strand; PAM type: YTN; PAM sequence: TTT
ttggagagactaataaaatc

SEQ ID NO: 15939 - DNA, 20 bp, Artificial Sequence
  Description of Artificial Sequence: Synthetic oligonucleotide
  Target: AGXT; (-) strand; PAM type: YTN; PAM sequence: TTT
tttggagagactaataaaat

SEQ ID NO: 15940 - DNA, 20 bp, Artificial Sequence
  Description of Artificial Sequence: Synthetic oligonucleotide
  Target: AGXT; (-) strand; PAM type: YTN; PAM sequence: CTT
ttttggagagactaataaaa

SEQ ID NO: 15941 - DNA, 20 bp, Artificial Sequence
  Description of Artificial Sequence: Synthetic oligonucleotide
  Target: AGXT; (-) strand; PAM type: YTN; PAM sequence: TTG
agaaaatgatggtaaatgtc

SEQ ID NO: 15942 - DNA, 20 bp, Artificial Sequence
  Description of Artificial Sequence: Synthetic oligonucleotide
  Target: AGXT; (-) strand; PAM type: YTN; PAM sequence: TTA
aaaccaaaggaagtaaaata

SEQ ID NO: 15943 - DNA, 20 bp, Artificial Sequence
  Description of Artificial Sequence: Synthetic oligonucleotide
  Target: AGXT; (-) strand; PAM type: YTN; PAM sequence: CTA
gaaaaagaggagcaaattaa

SEQ ID NO: 15944 - DNA, 20 bp, Artificial Sequence
  Description of Artificial Sequence: Synthetic oligonucleotide
  Target: AGXT; (-) strand; PAM type: YTN; PAM sequence: CTA
ccataggaagctagaaaaag

SEQ ID NO: 15945 - DNA, 20 bp, Artificial Sequence
  Description of Artificial Sequence: Synthetic oligonucleotide
  Target: AGXT; (-) strand; PAM type: YTN; PAM sequence: TTC
taccataggaagctagaaaa

SEQ ID NO: 15946 - DNA, 20 bp, Artificial Sequence
  Description of Artificial Sequence: Synthetic oligonucleotide
  Target: AGXT; (-) strand; PAM type: YTN; PAM sequence: CTT
ctaccataggaagctagaaa

SEQ ID NO: 15947 - DNA, 20 bp, Artificial Sequence
  Description of Artificial Sequence: Synthetic oligonucleotide
  Target: AGXT; (-) strand; PAM type: YTN; PAM sequence: TTA
agcttctaccataggaagct

SEQ ID NO: 15948 - DNA, 20 bp, Artificial Sequence
  Description of Artificial Sequence: Synthetic oligonucleotide
  Target: AGXT; (-) strand; PAM type: YTN; PAM sequence: TTA
aaatcaattaagcttctacc

SEQ ID NO: 15949 - DNA, 20 bp, Artificial Sequence
  Description of Artificial Sequence: Synthetic oligonucleotide
  Target: AGXT; (-) strand; PAM type: YTN; PAM sequence: TTT
aaaatcaattaagcttctac

SEQ ID NO: 15950 - DNA, 20 bp, Artificial Sequence
  Description of Artificial Sequence: Synthetic oligonucleotide
  Target: AGXT; (-) strand; PAM type: YTN; PAM sequence: CTA
gaaaacaaataaatgtttaa

SEQ ID NO: 15951 - DNA, 20 bp, Artificial Sequence
  Description of Artificial Sequence: Synthetic oligonucleotide
  Target: AGXT; (-) strand; PAM type: YTN; PAM sequence: CTC
atactagaaaacaaataaat

SEQ ID NO: 15952 - DNA, 20 bp, Artificial Sequence
  Description of Artificial Sequence: Synthetic oligonucleotide
  Target: AGXT; (-) strand; PAM type: YTN; PAM sequence: TTA
aatgctcatactagaaaaca

SEQ ID NO: 15953 - DNA, 20 bp, Artificial Sequence
  Description of Artificial Sequence: Synthetic oligonucleotide
  Target: AGXT; (-) strand; PAM type: YTN; PAM sequence: TTT
aaatgctcatactagaaaac

SEQ ID NO: 15954 - DNA, 20 bp, Artificial Sequence
  Description of Artificial Sequence: Synthetic oligonucleotide
  Target: AGXT; (-) strand; PAM type: YTN; PAM sequence: CTT
taaatgctcatactagaaaa

SEQ ID NO: 15955 - DNA, 20 bp, Artificial Sequence
  Description of Artificial Sequence: Synthetic oligonucleotide
  Target: AGXT; (-) strand; PAM type: YTN; PAM sequence: TTA
gctttaaatgctcatactag

SEQ ID NO: 15956 - DNA, 20 bp, Artificial Sequence
  Description of Artificial Sequence: Synthetic oligonucleotide
  Target: AGXT; (-) strand; PAM type: YTN; PAM sequence: TTT
agctttaaatgctcatacta

SEQ ID NO: 15957 - DNA, 20 bp, Artificial Sequence
  Description of Artificial Sequence: Synthetic oligonucleotide
  Target: AGXT; (-) strand; PAM type: YTN; PAM sequence: CTC
agagggaaatgtttagcttt

SEQ ID NO: 15958 - DNA, 20 bp, Artificial Sequence
  Description of Artificial Sequence: Synthetic oligonucleotide
  Target: AGXT; (-) strand; PAM type: YTN; PAM sequence: TTG
ggagatgcagtgaagaaggc

SEQ ID NO: 15959 - DNA, 20 bp, Artificial Sequence
  Description of Artificial Sequence: Synthetic oligonucleotide
  Target: AGXT; (-) strand; PAM type: YTN; PAM sequence: TTT
gggagatgcagtgaagaagg

SEQ ID NO: 15960 - DNA, 20 bp, Artificial Sequence
  Description of Artificial Sequence: Synthetic oligonucleotide
  Target: AGXT; (-) strand; PAM type: YTN; PAM sequence: TTA
aaatttgggagatgcagtga

SEQ ID NO: 15961 - DNA, 20 bp, Artificial Sequence
  Description of Artificial Sequence: Synthetic oligonucleotide
  Target: AGXT; (-) strand; PAM type: YTN; PAM sequence: TTG
attaaaatttgggagatgca

SEQ ID NO: 15962 - DNA, 20 bp, Artificial Sequence
  Description of Artificial Sequence: Synthetic oligonucleotide
  Target: AGXT; (-) strand; PAM type: YTN; PAM sequence: TTC
caaaaacaccattgattaaa

SEQ ID NO: 15963 - DNA, 20 bp, Artificial Sequence
  Description of Artificial Sequence: Synthetic oligonucleotide
  Target: AGXT; (-) strand; PAM type: YTN; PAM sequence: CTG
agtgattccaaaaacaccat

SEQ ID NO: 15964 - DNA, 20 bp, Artificial Sequence
  Description of Artificial Sequence: Synthetic oligonucleotide
  Target: AGXT; (-) strand; PAM type: YTN; PAM sequence: TTG
atctgagtgattccaaaaac

SEQ ID NO: 15965 - DNA, 20 bp, Artificial Sequence
  Description of Artificial Sequence: Synthetic oligonucleotide
  Target: AGXT; (-) strand; PAM type: YTN; PAM sequence: TTT
gatctgagtgattccaaaaa

SEQ ID NO: 15966 - DNA, 20 bp, Artificial Sequence
  Description of Artificial Sequence: Synthetic oligonucleotide
  Target: AGXT; (-) strand; PAM type: YTN; PAM sequence: TTT
tgatctgagtgattccaaaa

SEQ ID NO: 15967 - DNA, 20 bp, Artificial Sequence
  Description of Artificial Sequence: Synthetic oligonucleotide
  Target: AGXT; (-) strand; PAM type: YTN; PAM sequence: TTA
taaaatattttgatctgagt

SEQ ID NO: 15968 - DNA, 20 bp, Artificial Sequence
  Description of Artificial Sequence: Synthetic oligonucleotide
  Target: AGXT; (-) strand; PAM type: YTN; PAM sequence: TTC
aaagaataaatcacaaggaa

SEQ ID NO: 15969 - DNA, 20 bp, Artificial Sequence
  Description of Artificial Sequence: Synthetic oligonucleotide
  Target: AGXT; (-) strand; PAM type: YTN; PAM sequence: CTG
tggttcaaagaataaatcac

SEQ ID NO: 15970 - DNA, 20 bp, Artificial Sequence
  Description of Artificial Sequence: Synthetic oligonucleotide
  Target: AGXT; (-) strand; PAM type: YTN; PAM sequence: CTA
aatagtctgtggttcaaaga

SEQ ID NO: 15971 - DNA, 20 bp, Artificial Sequence
  Description of Artificial Sequence: Synthetic oligonucleotide
  Target: AGXT; (-) strand; PAM type: YTN; PAM sequence: TTA
cacagtataagtctaaatag

SEQ ID NO: 15972 - DNA, 20 bp, Artificial Sequence
  Description of Artificial Sequence: Synthetic oligonucleotide
  Target: AGXT; (-) strand; PAM type: YTN; PAM sequence: CTG
aacattacacagtataagtc

SEQ ID NO: 15973 - DNA, 20 bp, Artificial Sequence
  Description of Artificial Sequence: Synthetic oligonucleotide
  Target: AGXT; (-) strand; PAM type: YTN; PAM sequence: TTA
gaatatccaccaaatatctg

SEQ ID NO: 15974 - DNA, 20 bp, Artificial Sequence
  Description of Artificial Sequence: Synthetic oligonucleotide
  Target: AGXT; (-) strand; PAM type: YTN; PAM sequence: TTT
agaatatccaccaaatatct

SEQ ID NO: 15975 - DNA, 20 bp, Artificial Sequence
  Description of Artificial Sequence: Synthetic oligonucleotide
  Target: AGXT; (-) strand; PAM type: YTN; PAM sequence: TTG
aaataaaaaacaaaaataca

SEQ ID NO: 15976 - DNA, 20 bp, Artificial Sequence
  Description of Artificial Sequence: Synthetic oligonucleotide
  Target: AGXT; (-) strand; PAM type: YTN; PAM sequence: TTT
gaaataaaaaacaaaaatac

SEQ ID NO: 15977 - DNA, 20 bp, Artificial Sequence
  Description of Artificial Sequence: Synthetic oligonucleotide
  Target: AGXT; (-) strand; PAM type: YTN; PAM sequence: CTG
accacaacagacataaattt

SEQ ID NO: 15978 - DNA, 20 bp, Artificial Sequence
  Description of Artificial Sequence: Synthetic oligonucleotide
  Target: AGXT; (-) strand; PAM type: YTN; PAM sequence: CTC
tgaccacaacagacataaat

SEQ ID NO: 15979 - DNA, 20 bp, Artificial Sequence
  Description of Artificial Sequence: Synthetic oligonucleotide
  Target: AGXT; (-) strand; PAM type: YTN; PAM sequence: CTG
aagtccatatacagtatgag

SEQ ID NO: 15980 - DNA, 20 bp, Artificial Sequence
  Description of Artificial Sequence: Synthetic oligonucleotide
  Target: AGXT; (-) strand; PAM type: YTN; PAM sequence: TTC
aaaatactgaagtccatata

SEQ ID NO: 15981 - DNA, 20 bp, Artificial Sequence
  Description of Artificial Sequence: Synthetic oligonucleotide
  Target: AGXT; (-) strand; PAM type: YTN; PAM sequence: CTC
agtacatgttcaaaatactg

SEQ ID NO: 15982 - DNA, 20 bp, Artificial Sequence
  Description of Artificial Sequence: Synthetic oligonucleotide
  Target: AGXT; (-) strand; PAM type: YTN; PAM sequence: CTC
tcagtacatgttcaaaatac

SEQ ID NO: 15983 - DNA, 20 bp, Artificial Sequence
  Description of Artificial Sequence: Synthetic oligonucleotide
  Target: AGXT; (-) strand; PAM type: YTN; PAM sequence: TTA
taaaacagactctcagtaca

SEQ ID NO: 15984 - DNA, 20 bp, Artificial Sequence
  Description of Artificial Sequence: Synthetic oligonucleotide
  Target: AGXT; (-) strand; PAM type: YTN; PAM sequence: TTT
ataaaacagactctcagtac

SEQ ID NO: 15985 - DNA, 20 bp, Artificial Sequence
  Description of Artificial Sequence: Synthetic oligonucleotide
  Target: AGXT; (-) strand; PAM type: YTN; PAM sequence: CTA
gtttataaaacagactctca

SEQ ID NO: 15986 - DNA, 20 bp, Artificial Sequence
  Description of Artificial Sequence: Synthetic oligonucleotide
  Target: AGXT; (-) strand; PAM type: YTN; PAM sequence: CTG
ctagtttataaaacagactc

SEQ ID NO: 15987 - DNA, 20 bp, Artificial Sequence
  Description of Artificial Sequence: Synthetic oligonucleotide
  Target: AGXT; (-) strand; PAM type: YTN; PAM sequence: CTG
ctgctagtttataaaacaga

SEQ ID NO: 15988 - DNA, 20 bp, Artificial Sequence
  Description of Artificial Sequence: Synthetic oligonucleotide
  Target: AGXT; (-) strand; PAM type: YTN; PAM sequence: CTC
gtgtccatgggatagtcacc

SEQ ID NO: 15989 - DNA, 20 bp, Artificial Sequence
  Description of Artificial Sequence: Synthetic oligonucleotide
  Target: AGXT; (-) strand; PAM type: YTN; PAM sequence: TTC
atctcgtgtccatgggatag

SEQ ID NO: 15990 - DNA, 20 bp, Artificial Sequence
  Description of Artificial Sequence: Synthetic oligonucleotide
  Target: AGXT; (-) strand; PAM type: YTN; PAM sequence: CTG
acaatgacgaagacacgttc

SEQ ID NO: 15991 - DNA, 20 bp, Artificial Sequence
  Description of Artificial Sequence: Synthetic oligonucleotide
  Target: AGXT; (-) strand; PAM type: YTN; PAM sequence: CTC
acacctgacaatgacgaaga

SEQ ID NO: 15992 - DNA, 20 bp, Artificial Sequence
  Description of Artificial Sequence: Synthetic oligonucleotide
  Target: AGXT; (-) strand; PAM type: YTN; PAM sequence: CTG
tagaagctcacacctgacaa

SEQ ID NO: 15993 - DNA, 20 bp, Artificial Sequence
  Description of Artificial Sequence: Synthetic oligonucleotide
  Target: AGXT; (-) strand; PAM type: YTN; PAM sequence: CTG
aggatctgtagaagctcaca

SEQ ID NO: 15994 - DNA, 20 bp, Artificial Sequence
  Description of Artificial Sequence: Synthetic oligonucleotide
  Target: AGXT; (-) strand; PAM type: YTN; PAM sequence: CTG
tcatccaggcggacctgagg

SEQ ID NO: 15995 - DNA, 20 bp, Artificial Sequence
  Description of Artificial Sequence: Synthetic oligonucleotide
  Target: AGXT; (-) strand; PAM type: YTN; PAM sequence: TTG
aacaatgctgtcatccaggc

SEQ ID NO: 15996 - DNA, 20 bp, Artificial Sequence
  Description of Artificial Sequence: Synthetic oligonucleotide
  Target: AGXT; (-) strand; PAM type: YTN; PAM sequence: CTT
gaacaatgctgtcatccagg

SEQ ID NO: 15997 - DNA, 20 bp, Artificial Sequence
  Description of Artificial Sequence: Synthetic oligonucleotide
  Target: AGXT; (-) strand; PAM type: YTN; PAM sequence: TTC
atagaaaaagcaggcaaaaa

SEQ ID NO: 15998 - DNA, 20 bp, Artificial Sequence
  Description of Artificial Sequence: Synthetic oligonucleotide
  Target: AGXT; (-) strand; PAM type: YTN; PAM sequence: CTT
catagaaaaagcaggcaaaa

SEQ ID NO: 15999 - DNA, 20 bp, Artificial Sequence
  Description of Artificial Sequence: Synthetic oligonucleotide
  Target: AGXT; (-) strand; PAM type: YTN; PAM sequence: CTC
agtacttcatagaaaaagca

SEQ ID NO: 16000 - DNA, 20 bp, Artificial Sequence
  Description of Artificial Sequence: Synthetic oligonucleotide
  Target: AGXT; (-) strand; PAM type: YTN; PAM sequence: CTC
tcagtacttcatagaaaaag

SEQ ID NO: 16001 - DNA, 20 bp, Artificial Sequence
  Description of Artificial Sequence: Synthetic oligonucleotide
  Target: AGXT; (-) strand; PAM type: YTN; PAM sequence: CTG
aacaccccactctcagtact

SEQ ID NO: 16002 - DNA, 20 bp, Artificial Sequence
  Description of Artificial Sequence: Synthetic oligonucleotide
  Target: AGXT; (-) strand; PAM type: YTN; PAM sequence: CTG
ggagaactgaacaccccact

SEQ ID NO: 16003 - DNA, 20 bp, Artificial Sequence
  Description of Artificial Sequence: Synthetic oligonucleotide
  Target: AGXT; (-) strand; PAM type: YTN; PAM sequence: TTC
atgctgggagaactgaacac

SEQ ID NO: 16004 - DNA, 20 bp, Artificial Sequence
  Description of Artificial Sequence: Synthetic oligonucleotide
  Target: AGXT; (-) strand; PAM type: YTN; PAM sequence: TTC
aaaatcatgaagatgaatgc

SEQ ID NO: 16005 - DNA, 20 bp, Artificial Sequence
  Description of Artificial Sequence: Synthetic oligonucleotide
  Target: AGXT; (-) strand; PAM type: YTN; PAM sequence: CTT
caaaatcatgaagatgaatg

SEQ ID NO: 16006 - DNA, 20 bp, Artificial Sequence
  Description of Artificial Sequence: Synthetic oligonucleotide
  Target: AGXT; (-) strand; PAM type: YTN; PAM sequence: CTA
acaacagaccttcaaaatca

SEQ ID NO: 16007 - DNA, 20 bp, Artificial Sequence
  Description of Artificial Sequence: Synthetic oligonucleotide
  Target: AGXT; (-) strand; PAM type: YTN; PAM sequence: TTC
atcaagaaggtgtaacaatc

SEQ ID NO: 16008 - DNA, 20 bp, Artificial Sequence
  Description of Artificial Sequence: Synthetic oligonucleotide
  Target: AGXT; (-) strand; PAM type: YTN; PAM sequence: TTC
acaatgataaaaatagtcag

SEQ ID NO: 16009 - DNA, 20 bp, Artificial Sequence
  Description of Artificial Sequence: Synthetic oligonucleotide
  Target: AGXT; (-) strand; PAM type: YTN; PAM sequence: TTT
cacaatgataaaaatagtca

SEQ ID NO: 16010 - DNA, 20 bp, Artificial Sequence
  Description of Artificial Sequence: Synthetic oligonucleotide
  Target: AGXT; (-) strand; PAM type: YTN; PAM sequence: TTA
ccagaggtaaggggcgatat

SEQ ID NO: 16011 - DNA, 20 bp, Artificial Sequence
  Description of Artificial Sequence: Synthetic oligonucleotide
  Target: AGXT; (-) strand; PAM type: YTN; PAM sequence: TTA
agacaaagagtattaccaga

SEQ ID NO: 16012 - DNA, 20 bp, Artificial Sequence
  Description of Artificial Sequence: Synthetic oligonucleotide
  Target: AGXT; (-) strand; PAM type: YTN; PAM sequence: TTG
tatggagagacaagtggccc

SEQ ID NO: 16013 - DNA, 20 bp, Artificial Sequence
  Description of Artificial Sequence: Synthetic oligonucleotide
  Target: AGXT; (-) strand; PAM type: YTN; PAM sequence: TTT
gtatggagagacaagtggcc

SEQ ID NO: 16014 - DNA, 20 bp, Artificial Sequence
  Description of Artificial Sequence: Synthetic oligonucleotide
  Target: AGXT; (-) strand; PAM type: YTN; PAM sequence: TTT
tgtatggagagacaagtggc

SEQ ID NO: 16015 - DNA, 20 bp, Artificial Sequence
  Description of Artificial Sequence: Synthetic oligonucleotide
  Target: AGXT; (-) strand; PAM type: YTN; PAM sequence: CTT
ttgtatggagagacaagtgg

SEQ ID NO: 16016 - DNA, 20 bp, Artificial Sequence
  Description of Artificial Sequence: Synthetic oligonucleotide
  Target: AGXT; (-) strand; PAM type: YTN; PAM sequence: CTC
ttttgtatggagagacaagt

SEQ ID NO: 16017 - DNA, 20 bp, Artificial Sequence
  Description of Artificial Sequence: Synthetic oligonucleotide
  Target: AGXT; (-) strand; PAM type: YTN; PAM sequence: TTC
atctcttttgtatggagaga

SEQ ID NO: 16018 - DNA, 20 bp, Artificial Sequence
  Description of Artificial Sequence: Synthetic oligonucleotide
  Target: AGXT; (-) strand; PAM type: YTN; PAM sequence: CTC
aaaaaaagaaaagaaaagaa

SEQ ID NO: 16019 - DNA, 20 bp, Artificial Sequence
  Description of Artificial Sequence: Synthetic oligonucleotide
  Target: AGXT; (-) strand; PAM type: YTN; PAM sequence: CTC
cgtctcaaaaaaagaaaaga

SEQ ID NO: 16020 - DNA, 20 bp, Artificial Sequence
  Description of Artificial Sequence: Synthetic oligonucleotide
  Target: AGXT; (-) strand; PAM type: YTN; PAM sequence: CTG
ggcaacaagagcgaaactcc

SEQ ID NO: 16021 - DNA, 20 bp, Artificial Sequence
  Description of Artificial Sequence: Synthetic oligonucleotide
  Target: AGXT; (-) strand; PAM type: YTN; PAM sequence: CTC
cagcctgggcaacaagagcg

SEQ ID NO: 16022 - DNA, 20 bp, Artificial Sequence
  Description of Artificial Sequence: Synthetic oligonucleotide
  Target: AGXT; (-) strand; PAM type: YTN; PAM sequence: TTG
cactccagcctgggcaacaa

SEQ ID NO: 16023 - DNA, 20 bp, Artificial Sequence
  Description of Artificial Sequence: Synthetic oligonucleotide
  Target: AGXT; (-) strand; PAM type: YTN; PAM sequence: TTG
cggtaagccgagatcccacc

SEQ ID NO: 16024 - DNA, 20 bp, Artificial Sequence
  Description of Artificial Sequence: Synthetic oligonucleotide
  Target: AGXT; (-) strand; PAM type: YTN; PAM sequence: CTG
ggaggtggaggttgcggtaa

SEQ ID NO: 16025 - DNA, 20 bp, Artificial Sequence
  Description of Artificial Sequence: Synthetic oligonucleotide
  Target: AGXT; (-) strand; PAM type: YTN; PAM sequence: TTG
aacctgggaggtggaggttg

SEQ ID NO: 16026 - DNA, 20 bp, Artificial Sequence
  Description of Artificial Sequence: Synthetic oligonucleotide
  Target: AGXT; (-) strand; PAM type: YTN; PAM sequence: CTT
gaacctgggaggtggaggtt

SEQ ID NO: 16027 - DNA, 20 bp, Artificial Sequence
  Description of Artificial Sequence: Synthetic oligonucleotide
  Target: AGXT; (-) strand; PAM type: YTN; PAM sequence: TTG
cttgaacctgggaggtggag

SEQ ID NO: 16028 - DNA, 20 bp, Artificial Sequence
  Description of Artificial Sequence: Synthetic oligonucleotide
  Target: AGXT; (-) strand; PAM type: YTN; PAM sequence: CTG
aggcaggagaattgcttgaa

SEQ ID NO: 16029 - DNA, 20 bp, Artificial Sequence
  Description of Artificial Sequence: Synthetic oligonucleotide
  Target: AGXT; (-) strand; PAM type: YTN; PAM sequence: CTC
gggaggctgaggcaggagaa

SEQ ID NO: 16030 - DNA, 20 bp, Artificial Sequence
  Description of Artificial Sequence: Synthetic oligonucleotide
  Target: AGXT; (-) strand; PAM type: YTN; PAM sequence: CTA
ctcgggaggctgaggcagga

SEQ ID NO: 16031 - DNA, 20 bp, Artificial Sequence
  Description of Artificial Sequence: Synthetic oligonucleotide
  Target: AGXT; (-) strand; PAM type: YTN; PAM sequence: CTG
taatcccagctactcgggag

SEQ ID NO: 16032 - DNA, 20 bp, Artificial Sequence
  Description of Artificial Sequence: Synthetic oligonucleotide
  Target: AGXT; (-) strand; PAM type: YTN; PAM sequence: TTA
gccgggcatggtggcaggtg

SEQ ID NO: 16033 - DNA, 20 bp, Artificial Sequence
  Description of Artificial Sequence: Synthetic oligonucleotide
  Target: AGXT; (-) strand; PAM type: YTN; PAM sequence: CTA
aaaatacaaaaaattagccg

SEQ ID NO: 16034 - DNA, 20 bp, Artificial Sequence
  Description of Artificial Sequence: Synthetic oligonucleotide
  Target: AGXT; (-) strand; PAM type: YTN; PAM sequence: CTA
ctaaaaatacaaaaaattag

SEQ ID NO: 16035 - DNA, 20 bp, Artificial Sequence
  Description of Artificial Sequence: Synthetic oligonucleotide
  Target: AGXT; (-) strand; PAM type: YTN; PAM sequence: CTC
tactaaaaatacaaaaaatt

SEQ ID NO: 16036 - DNA, 20 bp, Artificial Sequence
  Description of Artificial Sequence: Synthetic oligonucleotide
  Target: AGXT; (-) strand; PAM type: YTN; PAM sequence: CTG
gccaacatggtaaaaccccg

SEQ ID NO: 16037 - DNA, 20 bp, Artificial Sequence
  Description of Artificial Sequence: Synthetic oligonucleotide
  Target: AGXT; (-) strand; PAM type: YTN; PAM sequence: TTC
gagaccagcctggccaacat

SEQ ID NO: 16038 - DNA, 20 bp, Artificial Sequence
  Description of Artificial Sequence: Synthetic oligonucleotide
  Target: AGXT; (-) strand; PAM type: YTN; PAM sequence: CTG
aggtcaggagttcgagacca

SEQ ID NO: 16039 - DNA, 20 bp, Artificial Sequence
  Description of Artificial Sequence: Synthetic oligonucleotide
  Target: AGXT; (-) strand; PAM type: YTN; PAM sequence: TTG
ggaggccggggtgggtggat

SEQ ID NO: 16040 - DNA, 20 bp, Artificial Sequence
  Description of Artificial Sequence: Synthetic oligonucleotide
  Target: AGXT; (-) strand; PAM type: YTN; PAM sequence: TTT
gggaggccggggtgggtgga

SEQ ID NO: 16041 - DNA, 20 bp, Artificial Sequence
  Description of Artificial Sequence: Synthetic oligonucleotide
  Target: AGXT; (-) strand; PAM type: YTN; PAM sequence: CTT
tgggaggccggggtgggtgg

SEQ ID NO: 16042 - DNA, 20 bp, Artificial Sequence
  Description of Artificial Sequence: Synthetic oligonucleotide
  Target: AGXT; (-) strand; PAM type: YTN; PAM sequence: CTG
taatcccagcactttgggag

SEQ ID NO: 16043 - DNA, 20 bp, Artificial Sequence
  Description of Artificial Sequence: Synthetic oligonucleotide
  Target: AGXT; (-) strand; PAM type: YTN; PAM sequence: CTC
acatctgtaatcccagcact

SEQ ID NO: 16044 - DNA, 20 bp, Artificial Sequence
  Description of Artificial Sequence: Synthetic oligonucleotide
  Target: AGXT; (-) strand; PAM type: YTN; PAM sequence: CTG
ggccaggcgcggtggctcac

SEQ ID NO: 16045 - DNA, 20 bp, Artificial Sequence
  Description of Artificial Sequence: Synthetic oligonucleotide
  Target: AGXT; (-) strand; PAM type: YTN; PAM sequence: CTC
cgcatgggcagagtatcaag

SEQ ID NO: 16046 - DNA, 20 bp, Artificial Sequence
  Description of Artificial Sequence: Synthetic oligonucleotide
  Target: AGXT; (-) strand; PAM type: YTN; PAM sequence: CTA
gaagagagtggtgagggaaa

SEQ ID NO: 16047 - DNA, 20 bp, Artificial Sequence
  Description of Artificial Sequence: Synthetic oligonucleotide
  Target: AGXT; (-) strand; PAM type: YTN; PAM sequence: TTC
ctagaagagagtggtgaggg

SEQ ID NO: 16048 - DNA, 20 bp, Artificial Sequence
  Description of Artificial Sequence: Synthetic oligonucleotide
  Target: AGXT; (-) strand; PAM type: YTN; PAM sequence: CTC
agggttcctagaagagagtg

SEQ ID NO: 16049 - DNA, 20 bp, Artificial Sequence
  Description of Artificial Sequence: Synthetic oligonucleotide
  Target: AGXT; (-) strand; PAM type: YTN; PAM sequence: TTC
ccaactcagggttcctagaa

SEQ ID NO: 16050 - DNA, 20 bp, Artificial Sequence
  Description of Artificial Sequence: Synthetic oligonucleotide
  Target: AGXT; (-) strand; PAM type: YTN; PAM sequence: TTT
cccaactcagggttcctaga

SEQ ID NO: 16051 - DNA, 20 bp, Artificial Sequence
  Description of Artificial Sequence: Synthetic oligonucleotide
  Target: AGXT; (-) strand; PAM type: YTN; PAM sequence: CTT
tcccaactcagggttcctag

SEQ ID NO: 16052 - DNA, 20 bp, Artificial Sequence
  Description of Artificial Sequence: Synthetic oligonucleotide
  Target: AGXT; (-) strand; PAM type: YTN; PAM sequence: TTG
gtgcgaaccaaaatggactt

SEQ ID NO: 16053 - DNA, 20 bp, Artificial Sequence
  Description of Artificial Sequence: Synthetic oligonucleotide
  Target: AGXT; (-) strand; PAM type: YTN; PAM sequence: TTT
ggtgcgaaccaaaatggact

SEQ ID NO: 16054 - DNA, 20 bp, Artificial Sequence
  Description of Artificial Sequence: Synthetic oligonucleotide
  Target: AGXT; (-) strand; PAM type: YTN; PAM sequence: TTT
tggtgcgaaccaaaatggac

SEQ ID NO: 16055 - DNA, 20 bp, Artificial Sequence
  Description of Artificial Sequence: Synthetic oligonucleotide
  Target: AGXT; (-) strand; PAM type: YTN; PAM sequence: CTT
ttggtgcgaaccaaaatgga

SEQ ID NO: 16056 - DNA, 20 bp, Artificial Sequence
  Description of Artificial Sequence: Synthetic oligonucleotide
  Target: AGXT; (-) strand; PAM type: YTN; PAM sequence: TTG
gtcttttggtgcgaaccaaa

SEQ ID NO: 16057 - DNA, 20 bp, Artificial Sequence
  Description of Artificial Sequence: Synthetic oligonucleotide
  Target: AGXT; (-) strand; PAM type: YTN; PAM sequence: CTT
ggtcttttggtgcgaaccaa

SEQ ID NO: 16058 - DNA, 20 bp, Artificial Sequence
  Description of Artificial Sequence: Synthetic oligonucleotide
  Target: AGXT; (+) strand; PAM type: YTN; PAM sequence: TTA
tgcagataaacaaactaaat

SEQ ID NO: 16059 - DNA, 20 bp, Artificial Sequence
  Description of Artificial Sequence: Synthetic oligonucleotide
  Target: AGXT; (+) strand; PAM type: YTN; PAM sequence: CTA
aatcaactgcttggccaccc

SEQ ID NO: 16060 - DNA, 20 bp, Artificial Sequence
  Description of Artificial Sequence: Synthetic oligonucleotide
  Target: AGXT; (+) strand; PAM type: YTN; PAM sequence: CTG
cttggccaccctctttcctc

SEQ ID NO: 16061 - DNA, 20 bp, Artificial Sequence
  Description of Artificial Sequence: Synthetic oligonucleotide
  Target: AGXT; (+) strand; PAM type: YTN; PAM sequence: CTT
ggccaccctctttcctcacc

SEQ ID NO: 16062 - DNA, 20 bp, Artificial Sequence
  Description of Artificial Sequence: Synthetic oligonucleotide
  Target: AGXT; (+) strand; PAM type: YTN; PAM sequence: TTG
gccaccctctttcctcaccc

SEQ ID NO: 16063 - DNA, 20 bp, Artificial Sequence
  Description of Artificial Sequence: Synthetic oligonucleotide
  Target: AGXT; (+) strand; PAM type: YTN; PAM sequence: CTC
tttcctcacccaatcccacc

SEQ ID NO: 16064 - DNA, 20 bp, Artificial Sequence
  Description of Artificial Sequence: Synthetic oligonucleotide
  Target: AGXT; (+) strand; PAM type: YTN; PAM sequence: CTT
tcctcacccaatcccaccaa

SEQ ID NO: 16065 - DNA, 20 bp, Artificial Sequence
  Description of Artificial Sequence: Synthetic oligonucleotide
  Target: AGXT; (+) strand; PAM type: YTN; PAM sequence: TTT
cctcacccaatcccaccaaa

SEQ ID NO: 16066 - DNA, 20 bp, Artificial Sequence
  Description of Artificial Sequence: Synthetic oligonucleotide
  Target: AGXT; (+) strand; PAM type: YTN; PAM sequence: TTC
ctcacccaatcccaccaaaa

SEQ ID NO: 16067 - DNA, 20 bp, Artificial Sequence
  Description of Artificial Sequence: Synthetic oligonucleotide
  Target: AGXT; (+) strand; PAM type: YTN; PAM sequence: CTC
acccaatcccaccaaaaccc

SEQ ID NO: 16068 - DNA, 20 bp, Artificial Sequence
  Description of Artificial Sequence: Synthetic oligonucleotide
  Target: AGXT; (+) strand; PAM type: YTN; PAM sequence: TTT
acaaaaggcactaaaacagg

SEQ ID NO: 16069 - DNA, 20 bp, Artificial Sequence
  Description of Artificial Sequence: Synthetic oligonucleotide
  Target: AGXT; (+) strand; PAM type: YTN; PAM sequence: TTA
caaaaggcactaaaacaggg

SEQ ID NO: 16070 - DNA, 20 bp, Artificial Sequence
  Description of Artificial Sequence: Synthetic oligonucleotide
  Target: AGXT; (+) strand; PAM type: YTN; PAM sequence: CTA
aaacagggtttcacattcat

SEQ ID NO: 16071 - DNA, 20 bp, Artificial Sequence
  Description of Artificial Sequence: Synthetic oligonucleotide
  Target: AGXT; (+) strand; PAM type: YTN; PAM sequence: TTT
cacattcattcctgaaggat

SEQ ID NO: 16072 - DNA, 20 bp, Artificial Sequence
  Description of Artificial Sequence: Synthetic oligonucleotide
  Target: AGXT; (+) strand; PAM type: YTN; PAM sequence: TTC
acattcattcctgaaggatg

SEQ ID NO: 16073 - DNA, 20 bp, Artificial Sequence
  Description of Artificial Sequence: Synthetic oligonucleotide
  Target: AGXT; (+) strand; PAM type: YTN; PAM sequence: TTC
attcctgaaggatggcttca

SEQ ID NO: 16074 - DNA, 20 bp, Artificial Sequence
  Description of Artificial Sequence: Synthetic oligonucleotide
  Target: AGXT; (+) strand; PAM type: YTN; PAM sequence: TTC
ctgaaggatggcttcaaaac

SEQ ID NO: 16075 - DNA, 20 bp, Artificial Sequence
  Description of Artificial Sequence: Synthetic oligonucleotide
  Target: AGXT; (+) strand; PAM type: YTN; PAM sequence: CTG
aaggatggcttcaaaactct

SEQ ID NO: 16076 - DNA, 20 bp, Artificial Sequence
  Description of Artificial Sequence: Synthetic oligonucleotide
  Target: AGXT; (+) strand; PAM type: YTN; PAM sequence: CTT
caaaactctgaaaataaact

SEQ ID NO: 16077 - DNA, 20 bp, Artificial Sequence
  Description of Artificial Sequence: Synthetic oligonucleotide
  Target: AGXT; (+) strand; PAM type: YTN; PAM sequence: TTC
aaaactctgaaaataaactt

SEQ ID NO: 16078 - DNA, 20 bp, Artificial Sequence
  Description of Artificial Sequence: Synthetic oligonucleotide
  Target: AGXT; (+) strand; PAM type: YTN; PAM sequence: CTC
tgaaaataaacttctcctcc

SEQ ID NO: 16079 - DNA, 20 bp, Artificial Sequence
  Description of Artificial Sequence: Synthetic oligonucleotide
  Target: AGXT; (+) strand; PAM type: YTN; PAM sequence: CTG
aaaataaacttctcctccct

SEQ ID NO: 16080 - DNA, 20 bp, Artificial Sequence
  Description of Artificial Sequence: Synthetic oligonucleotide
  Target: AGXT; (+) strand; PAM type: YTN; PAM sequence: CTT
ctcctccctgaggttccaca

SEQ ID NO: 16081 - DNA, 20 bp, Artificial Sequence
  Description of Artificial Sequence: Synthetic oligonucleotide
  Target: AGXT; (+) strand; PAM type: YTN; PAM sequence: TTC
tcctccctgaggttccacaa

SEQ ID NO: 16082 - DNA, 20 bp, Artificial Sequence
  Description of Artificial Sequence: Synthetic oligonucleotide
  Target: AGXT; (+) strand; PAM type: YTN; PAM sequence: CTC
ctccctgaggttccacaatg

SEQ ID NO: 16083 - DNA, 20 bp, Artificial Sequence
  Description of Artificial Sequence: Synthetic oligonucleotide
  Target: AGXT; (+) strand; PAM type: YTN; PAM sequence: CTC
cctgaggttccacaatggaa

SEQ ID NO: 16084 - DNA, 20 bp, Artificial Sequence
  Description of Artificial Sequence: Synthetic oligonucleotide
  Target: AGXT; (+) strand; PAM type: YTN; PAM sequence: CTG
aggttccacaatggaaaatc

SEQ ID NO: 16085 - DNA, 20 bp, Artificial Sequence
  Description of Artificial Sequence: Synthetic oligonucleotide
  Target: AGXT; (+) strand; PAM type: YTN; PAM sequence: TTC
cacaatggaaaatcctctaa

SEQ ID NO: 16086 - DNA, 20 bp, Artificial Sequence
  Description of Artificial Sequence: Synthetic oligonucleotide
  Target: AGXT; (+) strand; PAM type: YTN; PAM sequence: CTC
taaaatctccatcaagctaa

SEQ ID NO: 16087 - DNA, 20 bp, Artificial Sequence
  Description of Artificial Sequence: Synthetic oligonucleotide
  Target: AGXT; (+) strand; PAM type: YTN; PAM sequence: CTA
aaatctccatcaagctaacc

SEQ ID NO: 16088 - DNA, 20 bp, Artificial Sequence
  Description of Artificial Sequence: Synthetic oligonucleotide
  Target: AGXT; (+) strand; PAM type: YTN; PAM sequence: CTC
catcaagctaaccacctggg

SEQ ID NO: 16089 - DNA, 20 bp, Artificial Sequence
  Description of Artificial Sequence: Synthetic oligonucleotide
  Target: AGXT; (+) strand; PAM type: YTN; PAM sequence: CTA
accacctgggggtggaaact

SEQ ID NO: 16090 - DNA, 20 bp, Artificial Sequence
  Description of Artificial Sequence: Synthetic oligonucleotide
  Target: AGXT; (+) strand; PAM type: YTN; PAM sequence: CTG
ggggtggaaactttacaagc

SEQ ID NO: 16091 - DNA, 20 bp, Artificial Sequence
  Description of Artificial Sequence: Synthetic oligonucleotide
  Target: AGXT; (+) strand; PAM type: YTN; PAM sequence: CTT
tacaagccttaagagatcct

SEQ ID NO: 16092 - DNA, 20 bp, Artificial Sequence
  Description of Artificial Sequence: Synthetic oligonucleotide
  Target: AGXT; (+) strand; PAM type: YTN; PAM sequence: TTT
acaagccttaagagatcctc

SEQ ID NO: 16093 - DNA, 20 bp, Artificial Sequence
  Description of Artificial Sequence: Synthetic oligonucleotide
  Target: AGXT; (+) strand; PAM type: YTN; PAM sequence: TTA
caagccttaagagatcctct

SEQ ID NO: 16094 - DNA, 20 bp, Artificial Sequence
  Description of Artificial Sequence: Synthetic oligonucleotide
  Target: AGXT; (+) strand; PAM type: YTN; PAM sequence: CTT
aagagatcctctttttcaag

SEQ ID NO: 16095 - DNA, 20 bp, Artificial Sequence
  Description of Artificial Sequence: Synthetic oligonucleotide
  Target: AGXT; (+) strand; PAM type: YTN; PAM sequence: TTA
agagatcctctttttcaagg

SEQ ID NO: 16096 - DNA, 20 bp, Artificial Sequence
  Description of Artificial Sequence: Synthetic oligonucleotide
  Target: AGXT; (+) strand; PAM type: YTN; PAM sequence: CTC
tttttcaagggcctaaccta

SEQ ID NO: 16097 - DNA, 20 bp, Artificial Sequence
  Description of Artificial Sequence: Synthetic oligonucleotide
  Target: AGXT; (+) strand; PAM type: YTN; PAM sequence: CTT
tttcaagggcctaacctagc

SEQ ID NO: 16098 - DNA, 20 bp, Artificial Sequence
  Description of Artificial Sequence: Synthetic oligonucleotide
  Target: AGXT; (+) strand; PAM type: YTN; PAM sequence: TTT
ttcaagggcctaacctagcc

SEQ ID NO: 16099 - DNA, 20 bp, Artificial Sequence
  Description of Artificial Sequence: Synthetic oligonucleotide
  Target: AGXT; (+) strand; PAM type: YTN; PAM sequence: TTT
tcaagggcctaacctagcct

SEQ ID NO: 16100 - DNA, 20 bp, Artificial Sequence
  Description of Artificial Sequence: Synthetic oligonucleotide
  Target: AGXT; (+) strand; PAM type: YTN; PAM sequence: TTT
caagggcctaacctagccta

SEQ ID NO: 16101 - DNA, 20 bp, Artificial Sequence
  Description of Artificial Sequence: Synthetic oligonucleotide
  Target: AGXT; (+) strand; PAM type: YTN; PAM sequence: TTC
aagggcctaacctagcctag

SEQ ID NO: 16102 - DNA, 20 bp, Artificial Sequence
  Description of Artificial Sequence: Synthetic oligonucleotide
  Target: AGXT; (+) strand; PAM type: YTN; PAM sequence: CTA
acctagcctagccccaactc

SEQ ID NO: 16103 - DNA, 20 bp, Artificial Sequence
  Description of Artificial Sequence: Synthetic oligonucleotide
  Target: AGXT; (+) strand; PAM type: YTN; PAM sequence: CTA
gcctagccccaactctatgg

SEQ ID NO: 16104 - DNA, 20 bp, Artificial Sequence
  Description of Artificial Sequence: Synthetic oligonucleotide
  Target: AGXT; (+) strand; PAM type: YTN; PAM sequence: CTA
gccccaactctatgggacat

SEQ ID NO: 16105 - DNA, 20 bp, Artificial Sequence
  Description of Artificial Sequence: Synthetic oligonucleotide
  Target: AGXT; (+) strand; PAM type: YTN; PAM sequence: CTC
tatgggacatttcccaatcc

SEQ ID NO: 16106 - DNA, 20 bp, Artificial Sequence
  Description of Artificial Sequence: Synthetic oligonucleotide
  Target: AGXT; (+) strand; PAM type: YTN; PAM sequence: CTA
tgggacatttcccaatcctg

SEQ ID NO: 16107 - DNA, 20 bp, Artificial Sequence
  Description of Artificial Sequence: Synthetic oligonucleotide
  Target: AGXT; (+) strand; PAM type: YTN; PAM sequence: TTT
cccaatcctgcccaatttgc

SEQ ID NO: 16108 - DNA, 20 bp, Artificial Sequence
  Description of Artificial Sequence: Synthetic oligonucleotide
  Target: AGXT; (+) strand; PAM type: YTN; PAM sequence: TTC
ccaatcctgcccaatttgct

SEQ ID NO: 16109 - DNA, 20 bp, Artificial Sequence
  Description of Artificial Sequence: Synthetic oligonucleotide
  Target: AGXT; (+) strand; PAM type: YTN; PAM sequence: CTG
cccaatttgctgtcaatcaa

SEQ ID NO: 16110 - DNA, 20 bp, Artificial Sequence
  Description of Artificial Sequence: Synthetic oligonucleotide
  Target: AGXT; (+) strand; PAM type: YTN; PAM sequence: TTT
gctgtcaatcaaatcctgag

SEQ ID NO: 16111 - DNA, 20 bp, Artificial Sequence
  Description of Artificial Sequence: Synthetic oligonucleotide
  Target: AGXT; (+) strand; PAM type: YTN; PAM sequence: TTG
ctgtcaatcaaatcctgagg

SEQ ID NO: 16112 - DNA, 20 bp, Artificial Sequence
  Description of Artificial Sequence: Synthetic oligonucleotide
  Target: AGXT; (+) strand; PAM type: YTN; PAM sequence: CTG
tcaatcaaatcctgagggtg

SEQ ID NO: 16113 - DNA, 20 bp, Artificial Sequence
  Description of Artificial Sequence: Synthetic oligonucleotide
  Target: AGXT; (+) strand; PAM type: YTN; PAM sequence: CTG
agggtgcaatgaaccccctg

SEQ ID NO: 16114 - DNA, 20 bp, Artificial Sequence
  Description of Artificial Sequence: Synthetic oligonucleotide
  Target: AGXT; (+) strand; PAM type: YTN; PAM sequence: CTG
ccctcctccaacctattcaa

SEQ ID NO: 16115 - DNA, 20 bp, Artificial Sequence
  Description of Artificial Sequence: Synthetic oligonucleotide
  Target: AGXT; (+) strand; PAM type: YTN; PAM sequence: CTC
ctccaacctattcaacgtag

SEQ ID NO: 16116 - DNA, 20 bp, Artificial Sequence
  Description of Artificial Sequence: Synthetic oligonucleotide
  Target: AGXT; (+) strand; PAM type: YTN; PAM sequence: CTC
caacctattcaacgtagagg

SEQ ID NO: 16117 - DNA, 20 bp, Artificial Sequence
  Description of Artificial Sequence: Synthetic oligonucleotide
  Target: AGXT; (+) strand; PAM type: YTN; PAM sequence: CTA
ttcaacgtagagggcctgtc

SEQ ID NO: 16118 - DNA, 20 bp, Artificial Sequence
  Description of Artificial Sequence: Synthetic oligonucleotide
  Target: AGXT; (+) strand; PAM type: YTN; PAM sequence: TTC
aacgtagagggcctgtccca

SEQ ID NO: 16119 - DNA, 20 bp, Artificial Sequence
  Description of Artificial Sequence: Synthetic oligonucleotide
  Target: AGXT; (+) strand; PAM type: YTN; PAM sequence: CTG
tcccaggggcgtactggcaa

SEQ ID NO: 16120 - DNA, 20 bp, Artificial Sequence
  Description of Artificial Sequence: Synthetic oligonucleotide
  Target: AGXT; (+) strand; PAM type: YTN; PAM sequence: CTG
gcaagctgactctgcccaca

SEQ ID NO: 16121 - DNA, 20 bp, Artificial Sequence
  Description of Artificial Sequence: Synthetic oligonucleotide
  Target: AGXT; (+) strand; PAM type: YTN; PAM sequence: CTG
actctgcccacatgccctct

SEQ ID NO: 16122 - DNA, 20 bp, Artificial Sequence
  Description of Artificial Sequence: Synthetic oligonucleotide
  Target: AGXT; (+) strand; PAM type: YTN; PAM sequence: CTC
tgcccacatgccctctcata

SEQ ID NO: 16123 - DNA, 20 bp, Artificial Sequence
  Description of Artificial Sequence: Synthetic oligonucleotide
  Target: AGXT; (+) strand; PAM type: YTN; PAM sequence: CTG
cccacatgccctctcataag

SEQ ID NO: 16124 - DNA, 20 bp, Artificial Sequence
  Description of Artificial Sequence: Synthetic oligonucleotide
  Target: AGXT; (+) strand; PAM type: YTN; PAM sequence: CTC
tcataagggattcagatacc

SEQ ID NO: 16125 - DNA, 20 bp, Artificial Sequence
  Description of Artificial Sequence: Synthetic oligonucleotide
  Target: AGXT; (+) strand; PAM type: YTN; PAM sequence: CTC
ataagggattcagatacctt

SEQ ID NO: 16126 - DNA, 20 bp, Artificial Sequence
  Description of Artificial Sequence: Synthetic oligonucleotide
  Target: AGXT; (+) strand; PAM type: YTN; PAM sequence: TTC
agataccttttagtctttat

SEQ ID NO: 16127 - DNA, 20 bp, Artificial Sequence
  Description of Artificial Sequence: Synthetic oligonucleotide
  Target: AGXT; (+) strand; PAM type: YTN; PAM sequence: CTT
ttagtctttatagacacttt

SEQ ID NO: 16128 - DNA, 20 bp, Artificial Sequence
  Description of Artificial Sequence: Synthetic oligonucleotide
  Target: AGXT; (+) strand; PAM type: YTN; PAM sequence: TTT
tagtctttatagacactttc

SEQ ID NO: 16129 - DNA, 20 bp, Artificial Sequence
  Description of Artificial Sequence: Synthetic oligonucleotide
  Target: AGXT; (+) strand; PAM type: YTN; PAM sequence: TTT
agtctttatagacactttca

SEQ ID NO: 16130 - DNA, 20 bp, Artificial Sequence
  Description of Artificial Sequence: Synthetic oligonucleotide
  Target: AGXT; (+) strand; PAM type: YTN; PAM sequence: TTA
gtctttatagacactttcac

SEQ ID NO: 16131 - DNA, 20 bp, Artificial Sequence
  Description of Artificial Sequence: Synthetic oligonucleotide
  Target: AGXT; (+) strand; PAM type: YTN; PAM sequence: CTT
tatagacactttcacaagct

SEQ ID NO: 16132 - DNA, 20 bp, Artificial Sequence
  Description of Artificial Sequence: Synthetic oligonucleotide
  Target: AGXT; (+) strand; PAM type: YTN; PAM sequence: TTT
atagacactttcacaagctg

SEQ ID NO: 16133 - DNA, 20 bp, Artificial Sequence
  Description of Artificial Sequence: Synthetic oligonucleotide
  Target: AGXT; (+) strand; PAM type: YTN; PAM sequence: TTA
tagacactttcacaagctgg

SEQ ID NO: 16134 - DNA, 20 bp, Artificial Sequence
  Description of Artificial Sequence: Synthetic oligonucleotide
  Target: AGXT; (+) strand; PAM type: YTN; PAM sequence: CTT
tcacaagctggactaaagcc

SEQ ID NO: 16135 - DNA, 20 bp, Artificial Sequence
  Description of Artificial Sequence: Synthetic oligonucleotide
  Target: AGXT; (+) strand; PAM type: YTN; PAM sequence: TTT
cacaagctggactaaagcct

SEQ ID NO: 16136 - DNA, 20 bp, Artificial Sequence
  Description of Artificial Sequence: Synthetic oligonucleotide
  Target: AGXT; (+) strand; PAM type: YTN; PAM sequence: TTC
acaagctggactaaagcctt

SEQ ID NO: 16137 - DNA, 20 bp, Artificial Sequence
  Description of Artificial Sequence: Synthetic oligonucleotide
  Target: AGXT; (+) strand; PAM type: YTN; PAM sequence: CTG
gactaaagccttcccactcg

SEQ ID NO: 16138 - DNA, 20 bp, Artificial Sequence
  Description of Artificial Sequence: Synthetic oligonucleotide
  Target: AGXT; (+) strand; PAM type: YTN; PAM sequence: CTA
aagccttcccactcgaacag

SEQ ID NO: 16139 - DNA, 20 bp, Artificial Sequence
  Description of Artificial Sequence: Synthetic oligonucleotide
  Target: AGXT; (+) strand; PAM type: YTN; PAM sequence: CTT
cccactcgaacagaaagagc

SEQ ID NO: 16140 - DNA, 20 bp, Artificial Sequence
  Description of Artificial Sequence: Synthetic oligonucleotide
  Target: AGXT; (+) strand; PAM type: YTN; PAM sequence: TTC
ccactcgaacagaaagagca

SEQ ID NO: 16141 - DNA, 20 bp, Artificial Sequence
  Description of Artificial Sequence: Synthetic oligonucleotide
  Target: AGXT; (+) strand; PAM type: YTN; PAM sequence: CTC
gaacagaaagagcatcagaa

SEQ ID NO: 16142 - DNA, 20 bp, Artificial Sequence
  Description of Artificial Sequence: Synthetic oligonucleotide
  Target: AGXT; (+) strand; PAM type: YTN; PAM sequence: CTA
cggctcttttagaacacatt

SEQ ID NO: 16143 - DNA, 20 bp, Artificial Sequence
  Description of Artificial Sequence: Synthetic oligonucleotide
  Target: AGXT; (+) strand; PAM type: YTN; PAM sequence: CTC
ttttagaacacattattcct

SEQ ID NO: 16144 - DNA, 20 bp, Artificial Sequence
  Description of Artificial Sequence: Synthetic oligonucleotide
  Target: AGXT; (+) strand; PAM type: YTN; PAM sequence: CTT
ttagaacacattattcctcg

SEQ ID NO: 16145 - DNA, 20 bp, Artificial Sequence
  Description of Artificial Sequence: Synthetic oligonucleotide
  Target: AGXT; (+) strand; PAM type: YTN; PAM sequence: TTT
tagaacacattattcctcga

SEQ ID NO: 16146 - DNA, 20 bp, Artificial Sequence
  Description of Artificial Sequence: Synthetic oligonucleotide
  Target: AGXT; (+) strand; PAM type: YTN; PAM sequence: TTT
agaacacattattcctcgat

SEQ ID NO: 16147 - DNA, 20 bp, Artificial Sequence
  Description of Artificial Sequence: Synthetic oligonucleotide
  Target: AGXT; (+) strand; PAM type: YTN; PAM sequence: TTA
gaacacattattcctcgatt

SEQ ID NO: 16148 - DNA, 20 bp, Artificial Sequence
  Description of Artificial Sequence: Synthetic oligonucleotide
  Target: AGXT; (+) strand; PAM type: YTN; PAM sequence: TTA
ttcctcgatttggggtccct

SEQ ID NO: 16149 - DNA, 20 bp, Artificial Sequence
  Description of Artificial Sequence: Synthetic oligonucleotide
  Target: AGXT; (+) strand; PAM type: YTN; PAM sequence: TTC
ctcgatttggggtccctcaa

SEQ ID NO: 16150 - DNA, 20 bp, Artificial Sequence
  Description of Artificial Sequence: Synthetic oligonucleotide
  Target: AGXT; (+) strand; PAM type: YTN; PAM sequence: CTC
gatttggggtccctcaatcc

SEQ ID NO: 16151 - DNA, 20 bp, Artificial Sequence
  Description of Artificial Sequence: Synthetic oligonucleotide
  Target: AGXT; (+) strand; PAM type: YTN; PAM sequence: TTT
ggggtccctcaatccctcca

SEQ ID NO: 16152 - DNA, 20 bp, Artificial Sequence
  Description of Artificial Sequence: Synthetic oligonucleotide
  Target: AGXT; (+) strand; PAM type: YTN; PAM sequence: TTG
gggtccctcaatccctccaa

SEQ ID NO: 16153 - DNA, 20 bp, Artificial Sequence
  Description of Artificial Sequence: Synthetic oligonucleotide
  Target: AGXT; (+) strand; PAM type: YTN; PAM sequence: CTC
aatccctccaatcagacaat

SEQ ID NO: 16154 - DNA, 20 bp, Artificial Sequence
  Description of Artificial Sequence: Synthetic oligonucleotide
  Target: AGXT; (+) strand; PAM type: YTN; PAM sequence: CTC
caatcagacaatggcctggc

SEQ ID NO: 16155 - DNA, 20 bp, Artificial Sequence
  Description of Artificial Sequence: Synthetic oligonucleotide
  Target: AGXT; (+) strand; PAM type: YTN; PAM sequence: CTG
gcctttatttcttctattac

SEQ ID NO: 16156 - DNA, 20 bp, Artificial Sequence
  Description of Artificial Sequence: Synthetic oligonucleotide
  Target: AGXT; (+) strand; PAM type: YTN; PAM sequence: CTT
tatttcttctattactccag

SEQ ID NO: 16157 - DNA, 20 bp, Artificial Sequence
  Description of Artificial Sequence: Synthetic oligonucleotide
  Target: AGXT; (+) strand; PAM type: YTN; PAM sequence: TTT
atttcttctattactccagg

SEQ ID NO: 16158 - DNA, 20 bp, Artificial Sequence
  Description of Artificial Sequence: Synthetic oligonucleotide
  Target: AGXT; (+) strand; PAM type: YTN; PAM sequence: TTA
tttcttctattactccagga

SEQ ID NO: 16159 - DNA, 20 bp, Artificial Sequence
  Description of Artificial Sequence: Synthetic oligonucleotide
  Target: AGXT; (+) strand; PAM type: YTN; PAM sequence: TTT
cttctattactccaggaatc

SEQ ID NO: 16160 - DNA, 20 bp, Artificial Sequence
  Description of Artificial Sequence: Synthetic oligonucleotide
  Target: AGXT; (+) strand; PAM type: YTN; PAM sequence: TTC
ttctattactccaggaatca

SEQ ID NO: 16161 - DNA, 20 bp, Artificial Sequence
  Description of Artificial Sequence: Synthetic oligonucleotide
  Target: AGXT; (+) strand; PAM type: YTN; PAM sequence: CTT
ctattactccaggaatcagt

SEQ ID NO: 16162 - DNA, 20 bp, Artificial Sequence
  Description of Artificial Sequence: Synthetic oligonucleotide
  Target: AGXT; (+) strand; PAM type: YTN; PAM sequence: TTC
tattactccaggaatcagtg

SEQ ID NO: 16163 - DNA, 20 bp, Artificial Sequence
  Description of Artificial Sequence: Synthetic oligonucleotide
  Target: AGXT; (+) strand; PAM type: YTN; PAM sequence: CTA
ttactccaggaatcagtgag

SEQ ID NO: 16164 - DNA, 20 bp, Artificial Sequence
  Description of Artificial Sequence: Synthetic oligonucleotide
  Target: AGXT; (+) strand; PAM type: YTN; PAM sequence: TTA
ctccaggaatcagtgaggcc

SEQ ID NO: 16165 - DNA, 20 bp, Artificial Sequence
  Description of Artificial Sequence: Synthetic oligonucleotide
  Target: AGXT; (+) strand; PAM type: YTN; PAM sequence: CTC
caggaatcagtgaggccctc

SEQ ID NO: 16166 - DNA, 20 bp, Artificial Sequence
  Description of Artificial Sequence: Synthetic oligonucleotide
  Target: AGXT; (+) strand; PAM type: YTN; PAM sequence: CTC
caaataaaatatcacttaca

SEQ ID NO: 16167 - DNA, 20 bp, Artificial Sequence
  Description of Artificial Sequence: Synthetic oligonucleotide
  Target: AGXT; (+) strand; PAM type: YTN; PAM sequence: CTT
acatgctgcttaccacccac

SEQ ID NO: 16168 - DNA, 20 bp, Artificial Sequence
  Description of Artificial Sequence: Synthetic oligonucleotide
  Target: AGXT; (+) strand; PAM type: YTN; PAM sequence: TTA
catgctgcttaccacccaca

SEQ ID NO: 16169 - DNA, 20 bp, Artificial Sequence
  Description of Artificial Sequence: Synthetic oligonucleotide
  Target: AGXT; (+) strand; PAM type: YTN; PAM sequence: CTG
cttaccacccacagtcatcc

SEQ ID NO: 16170 - DNA, 20 bp, Artificial Sequence
  Description of Artificial Sequence: Synthetic oligonucleotide
  Target: AGXT; (+) strand; PAM type: YTN; PAM sequence: CTT
accacccacagtcatccaag

SEQ ID NO: 16171 - DNA, 20 bp, Artificial Sequence
  Description of Artificial Sequence: Synthetic oligonucleotide
  Target: AGXT; (+) strand; PAM type: YTN; PAM sequence: TTA
ccacccacagtcatccaagg

SEQ ID NO: 16172 - DNA, 20 bp, Artificial Sequence
  Description of Artificial Sequence: Synthetic oligonucleotide
  Target: AGXT; (+) strand; PAM type: YTN; PAM sequence: CTA
gctttgaaaacccttctcac

SEQ ID NO: 16173 - DNA, 20 bp, Artificial Sequence
  Description of Artificial Sequence: Synthetic oligonucleotide
  Target: AGXT; (+) strand; PAM type: YTN; PAM sequence: CTT
tgaaaacccttctcactaag

SEQ ID NO: 16174 - DNA, 20 bp, Artificial Sequence
  Description of Artificial Sequence: Synthetic oligonucleotide
  Target: AGXT; (+) strand; PAM type: YTN; PAM sequence: TTT
gaaaacccttctcactaagc

SEQ ID NO: 16175 - DNA, 20 bp, Artificial Sequence
  Description of Artificial Sequence: Synthetic oligonucleotide
  Target: AGXT; (+) strand; PAM type: YTN; PAM sequence: TTG
aaaacccttctcactaagct

SEQ ID NO: 16176 - DNA, 20 bp, Artificial Sequence
  Description of Artificial Sequence: Synthetic oligonucleotide
  Target: AGXT; (+) strand; PAM type: YTN; PAM sequence: CTT
ctcactaagctctctataga

SEQ ID NO: 16177 - DNA, 20 bp, Artificial Sequence
  Description of Artificial Sequence: Synthetic oligonucleotide
  Target: AGXT; (+) strand; PAM type: YTN; PAM sequence: TTC
tcactaagctctctatagaa

SEQ ID NO: 16178 - DNA, 20 bp, Artificial Sequence
  Description of Artificial Sequence: Synthetic oligonucleotide
  Target: AGXT; (+) strand; PAM type: YTN; PAM sequence: CTC
actaagctctctatagaaac

SEQ ID NO: 16179 - DNA, 20 bp, Artificial Sequence
  Description of Artificial Sequence: Synthetic oligonucleotide
  Target: AGXT; (+) strand; PAM type: YTN; PAM sequence: CTA
agctctctatagaaactcaa

SEQ ID NO: 16180 - DNA, 20 bp, Artificial Sequence
  Description of Artificial Sequence: Synthetic oligonucleotide
  Target: AGXT; (+) strand; PAM type: YTN; PAM sequence: CTC
tctatagaaactcaactgtt

SEQ ID NO: 16181 - DNA, 20 bp, Artificial Sequence
  Description of Artificial Sequence: Synthetic oligonucleotide
  Target: AGXT; (+) strand; PAM type: YTN; PAM sequence: CTC
tatagaaactcaactgtttt

SEQ ID NO: 16182 - DNA, 20 bp, Artificial Sequence
  Description of Artificial Sequence: Synthetic oligonucleotide
  Target: AGXT; (+) strand; PAM type: YTN; PAM sequence: CTA
tagaaactcaactgttttgg

SEQ ID NO: 16183 - DNA, 20 bp, Artificial Sequence
  Description of Artificial Sequence: Synthetic oligonucleotide
  Target: AGXT; (+) strand; PAM type: YTN; PAM sequence: CTC
aactgttttggataactttt

SEQ ID NO: 16184 - DNA, 20 bp, Artificial Sequence
  Description of Artificial Sequence: Synthetic oligonucleotide
  Target: AGXT; (+) strand; PAM type: YTN; PAM sequence: CTG
ttttggataacttttcttcc

SEQ ID NO: 16185 - DNA, 20 bp, Artificial Sequence
  Description of Artificial Sequence: Synthetic oligonucleotide
  Target: AGXT; (+) strand; PAM type: YTN; PAM sequence: TTT
tggataacttttcttcctat

SEQ ID NO: 16186 - DNA, 20 bp, Artificial Sequence
  Description of Artificial Sequence: Synthetic oligonucleotide
  Target: AGXT; (+) strand; PAM type: YTN; PAM sequence: TTT
ggataacttttcttcctatt

SEQ ID NO: 16187 - DNA, 20 bp, Artificial Sequence
  Description of Artificial Sequence: Synthetic oligonucleotide
  Target: AGXT; (+) strand; PAM type: YTN; PAM sequence: TTG
gataacttttcttcctattg

SEQ ID NO: 16188 - DNA, 20 bp, Artificial Sequence
  Description of Artificial Sequence: Synthetic oligonucleotide
  Target: AGXT; (+) strand; PAM type: YTN; PAM sequence: CTT
ttcttcctattgccctgtta

SEQ ID NO: 16189 - DNA, 20 bp, Artificial Sequence
  Description of Artificial Sequence: Synthetic oligonucleotide
  Target: AGXT; (+) strand; PAM type: YTN; PAM sequence: TTT
tcttcctattgccctgttaa

SEQ ID NO: 16190 - DNA, 20 bp, Artificial Sequence
  Description of Artificial Sequence: Synthetic oligonucleotide
  Target: AGXT; (+) strand; PAM type: YTN; PAM sequence: TTT
cttcctattgccctgttaag

SEQ ID NO: 16191 - DNA, 20 bp, Artificial Sequence
  Description of Artificial Sequence: Synthetic oligonucleotide
  Target: AGXT; (+) strand; PAM type: YTN; PAM sequence: TTC
ttcctattgccctgttaaga

SEQ ID NO: 16192 - DNA, 20 bp, Artificial Sequence
  Description of Artificial Sequence: Synthetic oligonucleotide
  Target: AGXT; (+) strand; PAM type: YTN; PAM sequence: CTT
cctattgccctgttaagatc

SEQ ID NO: 16193 - DNA, 20 bp, Artificial Sequence
  Description of Artificial Sequence: Synthetic oligonucleotide
  Target: AGXT; (+) strand; PAM type: YTN; PAM sequence: TTC
ctattgccctgttaagatct

SEQ ID NO: 16194 - DNA, 20 bp, Artificial Sequence
  Description of Artificial Sequence: Synthetic oligonucleotide
  Target: AGXT; (+) strand; PAM type: YTN; PAM sequence: CTA
ttgccctgttaagatctaga

SEQ ID NO: 16195 - DNA, 20 bp, Artificial Sequence
  Description of Artificial Sequence: Synthetic oligonucleotide
  Target: AGXT; (+) strand; PAM type: YTN; PAM sequence: TTG
ccctgttaagatctagagta

SEQ ID NO: 16196 - DNA, 20 bp, Artificial Sequence
  Description of Artificial Sequence: Synthetic oligonucleotide
  Target: AGXT; (+) strand; PAM type: YTN; PAM sequence: CTG
ttaagatctagagtaattcc

SEQ ID NO: 16197 - DNA, 20 bp, Artificial Sequence
  Description of Artificial Sequence: Synthetic oligonucleotide
  Target: AGXT; (+) strand; PAM type: YTN; PAM sequence: TTA
agatctagagtaattcccaa

SEQ ID NO: 16198 - DNA, 20 bp, Artificial Sequence
  Description of Artificial Sequence: Synthetic oligonucleotide
  Target: AGXT; (+) strand; PAM type: YTN; PAM sequence: CTA
gagtaattcccaaaggtttc

SEQ ID NO: 16199 - DNA, 20 bp, Artificial Sequence
  Description of Artificial Sequence: Synthetic oligonucleotide
  Target: AGXT; (+) strand; PAM type: YTN; PAM sequence: TTC
ccaaaggtttcaacccacct

SEQ ID NO: 16200 - DNA, 20 bp, Artificial Sequence
  Description of Artificial Sequence: Synthetic oligonucleotide
  Target: AGXT; (+) strand; PAM type: YTN; PAM sequence: TTT
caacccaccttagccctttt

SEQ ID NO: 16201 - DNA, 20 bp, Artificial Sequence
  Description of Artificial Sequence: Synthetic oligonucleotide
  Target: AGXT; (+) strand; PAM type: YTN; PAM sequence: TTC
aacccaccttagcccttttg

SEQ ID NO: 16202 - DNA, 20 bp, Artificial Sequence
  Description of Artificial Sequence: Synthetic oligonucleotide
  Target: AGXT; (+) strand; PAM type: YTN; PAM sequence: CTT
agcccttttgaaattattta

SEQ ID NO: 16203 - DNA, 20 bp, Artificial Sequence
  Description of Artificial Sequence: Synthetic oligonucleotide
  Target: AGXT; (+) strand; PAM type: YTN; PAM sequence: TTA
gcccttttgaaattatttat

SEQ ID NO: 16204 - DNA, 20 bp, Artificial Sequence
  Description of Artificial Sequence: Synthetic oligonucleotide
  Target: AGXT; (+) strand; PAM type: YTN; PAM sequence: CTT
ttgaaattatttatggatgc

SEQ ID NO: 16205 - DNA, 20 bp, Artificial Sequence
  Description of Artificial Sequence: Synthetic oligonucleotide
  Target: AGXT; (+) strand; PAM type: YTN; PAM sequence: TTT
tgaaattatttatggatgcc

SEQ ID NO: 16206 - DNA, 20 bp, Artificial Sequence
  Description of Artificial Sequence: Synthetic oligonucleotide
  Target: AGXT; (+) strand; PAM type: YTN; PAM sequence: TTT
gaaattatttatggatgccc

SEQ ID NO: 16207 - DNA, 20 bp, Artificial Sequence
  Description of Artificial Sequence: Synthetic oligonucleotide
  Target: AGXT; (+) strand; PAM type: YTN; PAM sequence: TTG
aaattatttatggatgcccc

SEQ ID NO: 16208 - DNA, 20 bp, Artificial Sequence
  Description of Artificial Sequence: Synthetic oligonucleotide
  Target: AGXT; (+) strand; PAM type: YTN; PAM sequence: TTA
tttatggatgccccttttta

SEQ ID NO: 16209 - DNA, 20 bp, Artificial Sequence
  Description of Artificial Sequence: Synthetic oligonucleotide
  Target: AGXT; (+) strand; PAM type: YTN; PAM sequence: TTT
atggatgcccctttttacaa

SEQ ID NO: 16210 - DNA, 20 bp, Artificial Sequence
  Description of Artificial Sequence: Synthetic oligonucleotide
  Target: AGXT; (+) strand; PAM type: YTN; PAM sequence: TTA
tggatgcccctttttacaaa

SEQ ID NO: 16211 - DNA, 20 bp, Artificial Sequence
  Description of Artificial Sequence: Synthetic oligonucleotide
  Target: AGXT; (+) strand; PAM type: YTN; PAM sequence: CTT
tttacaaacggacttattac

SEQ ID NO: 16212 - DNA, 20 bp, Artificial Sequence
  Description of Artificial Sequence: Synthetic oligonucleotide
  Target: AGXT; (+) strand; PAM type: YTN; PAM sequence: TTT
ttacaaacggacttattact

SEQ ID NO: 16213 - DNA, 20 bp, Artificial Sequence
  Description of Artificial Sequence: Synthetic oligonucleotide
  Target: AGXT; (+) strand; PAM type: YTN; PAM sequence: TTT
tacaaacggacttattactt

SEQ ID NO: 16214 - DNA, 20 bp, Artificial Sequence
  Description of Artificial Sequence: Synthetic oligonucleotide
  Target: AGXT; (+) strand; PAM type: YTN; PAM sequence: TTT
acaaacggacttattacttg

SEQ ID NO: 16215 - DNA, 20 bp, Artificial Sequence
  Description of Artificial Sequence: Synthetic oligonucleotide
  Target: AGXT; (+) strand; PAM type: YTN; PAM sequence: TTA
caaacggacttattacttga

SEQ ID NO: 16216 - DNA, 20 bp, Artificial Sequence
  Description of Artificial Sequence: Synthetic oligonucleotide
  Target: AGXT; (+) strand; PAM type: YTN; PAM sequence: CTT
attacttgatccagaggctc

SEQ ID NO: 16217 - DNA, 20 bp, Artificial Sequence
  Description of Artificial Sequence: Synthetic oligonucleotide
  Target: AGXT; (+) strand; PAM type: YTN; PAM sequence: TTA
ttacttgatccagaggctca

SEQ ID NO: 16218 - DNA, 20 bp, Artificial Sequence
  Description of Artificial Sequence: Synthetic oligonucleotide
  Target: AGXT; (+) strand; PAM type: YTN; PAM sequence: TTA
cttgatccagaggctcatta

SEQ ID NO: 16219 - DNA, 20 bp, Artificial Sequence
  Description of Artificial Sequence: Synthetic oligonucleotide
  Target: AGXT; (+) strand; PAM type: YTN; PAM sequence: CTT
gatccagaggctcattatct

SEQ ID NO: 16220 - DNA, 20 bp, Artificial Sequence
  Description of Artificial Sequence: Synthetic oligonucleotide
  Target: AGXT; (+) strand; PAM type: YTN; PAM sequence: TTG
atccagaggctcattatctg

SEQ ID NO: 16221 - DNA, 20 bp, Artificial Sequence
  Description of Artificial Sequence: Synthetic oligonucleotide
  Target: AGXT; (+) strand; PAM type: YTN; PAM sequence: CTC
attatctgtctcaatgtgat

SEQ ID NO: 16222 - DNA, 20 bp, Artificial Sequence
  Description of Artificial Sequence: Synthetic oligonucleotide
  Target: AGXT; (+) strand; PAM type: YTN; PAM sequence: TTA
tctgtctcaatgtgatgcct

SEQ ID NO: 16223 - DNA, 20 bp, Artificial Sequence
  Description of Artificial Sequence: Synthetic oligonucleotide
  Target: AGXT; (+) strand; PAM type: YTN; PAM sequence: CTG
tctcaatgtgatgcctccct

SEQ ID NO: 16224 - DNA, 20 bp, Artificial Sequence
  Description of Artificial Sequence: Synthetic oligonucleotide
  Target: AGXT; (+) strand; PAM type: YTN; PAM sequence: CTC
aatgtgatgcctccctgggc

SEQ ID NO: 16225 - DNA, 20 bp, Artificial Sequence
  Description of Artificial Sequence: Synthetic oligonucleotide
  Target: AGXT; (+) strand; PAM type: YTN; PAM sequence: CTC
cctgggcaaactatccaggc

SEQ ID NO: 16226 - DNA, 20 bp, Artificial Sequence
  Description of Artificial Sequence: Synthetic oligonucleotide
  Target: AGXT; (+) strand; PAM type: YTN; PAM sequence: CTG
ggcaaactatccaggccact

SEQ ID NO: 16227 - DNA, 20 bp, Artificial Sequence
  Description of Artificial Sequence: Synthetic oligonucleotide
  Target: AGXT; (+) strand; PAM type: YTN; PAM sequence: CTA
tccaggccactactgaatac

SEQ ID NO: 16228 - DNA, 20 bp, Artificial Sequence
  Description of Artificial Sequence: Synthetic oligonucleotide
  Target: AGXT; (+) strand; PAM type: YTN; PAM sequence: CTA
ctgaataccaggataaattt

SEQ ID NO: 16229 - DNA, 20 bp, Artificial Sequence
  Description of Artificial Sequence: Synthetic oligonucleotide
  Target: AGXT; (+) strand; PAM type: YTN; PAM sequence: CTG
aataccaggataaattttgt

SEQ ID NO: 16230 - DNA, 20 bp, Artificial Sequence
  Description of Artificial Sequence: Synthetic oligonucleotide
  Target: AGXT; (+) strand; PAM type: YTN; PAM sequence: TTT
tgtccaaaatctgacccctc

SEQ ID NO: 16231 - DNA, 20 bp, Artificial Sequence
  Description of Artificial Sequence: Synthetic oligonucleotide
  Target: AGXT; (+) strand; PAM type: YTN; PAM sequence: TTT
gtccaaaatctgacccctcc

SEQ ID NO: 16232 - DNA, 20 bp, Artificial Sequence
  Description of Artificial Sequence: Synthetic oligonucleotide
  Target: AGXT; (+) strand; PAM type: YTN; PAM sequence: TTG
tccaaaatctgacccctcct

SEQ ID NO: 16233 - DNA, 20 bp, Artificial Sequence
  Description of Artificial Sequence: Synthetic oligonucleotide
  Target: AGXT; (+) strand; PAM type: YTN; PAM sequence: CTG
acccctcctcatcagaacta

SEQ ID NO: 16234 - DNA, 20 bp, Artificial Sequence
  Description of Artificial Sequence: Synthetic oligonucleotide
  Target: AGXT; (+) strand; PAM type: YTN; PAM sequence: CTC
ctcatcagaactaagacctc

SEQ ID NO: 16235 - DNA, 20 bp, Artificial Sequence
  Description of Artificial Sequence: Synthetic oligonucleotide
  Target: AGXT; (+) strand; PAM type: YTN; PAM sequence: CTC
atcagaactaagacctcctg

SEQ ID NO: 16236 - DNA, 20 bp, Artificial Sequence
  Description of Artificial Sequence: Synthetic oligonucleotide
  Target: AGXT; (+) strand; PAM type: YTN; PAM sequence: CTA
agacctcctgttaacctggg

SEQ ID NO: 16237 - DNA, 20 bp, Artificial Sequence
  Description of Artificial Sequence: Synthetic oligonucleotide
  Target: AGXT; (+) strand; PAM type: YTN; PAM sequence: CTC
ctgttaacctggggactggg

SEQ ID NO: 16238 - DNA, 20 bp, Artificial Sequence
  Description of Artificial Sequence: Synthetic oligonucleotide
  Target: AGXT; (+) strand; PAM type: YTN; PAM sequence: CTG
ttaacctggggactgggtat

SEQ ID NO: 16239 - DNA, 20 bp, Artificial Sequence
  Description of Artificial Sequence: Synthetic oligonucleotide
  Target: AGXT; (+) strand; PAM type: YTN; PAM sequence: TTA
acctggggactgggtatatt

SEQ ID NO: 16240 - DNA, 20 bp, Artificial Sequence
  Description of Artificial Sequence: Synthetic oligonucleotide
  Target: AGXT; (+) strand; PAM type: YTN; PAM sequence: CTG
gggactgggtatatttaaaa

SEQ ID NO: 16241 - DNA, 20 bp, Artificial Sequence
  Description of Artificial Sequence: Synthetic oligonucleotide
  Target: AGXT; (+) strand; PAM type: YTN; PAM sequence: CTG
ggtatatttaaaaactttgc

SEQ ID NO: 16242 - DNA, 20 bp, Artificial Sequence
  Description of Artificial Sequence: Synthetic oligonucleotide
  Target: AGXT; (+) strand; PAM type: YTN; PAM sequence: TTT
aaaaactttgcctccagaca

SEQ ID NO: 16243 - DNA, 20 bp, Artificial Sequence
  Description of Artificial Sequence: Synthetic oligonucleotide
  Target: AGXT; (+) strand; PAM type: YTN; PAM sequence: TTA
aaaactttgcctccagacag

SEQ ID NO: 16244 - DNA, 20 bp, Artificial Sequence
  Description of Artificial Sequence: Synthetic oligonucleotide
  Target: AGXT; (+) strand; PAM type: YTN; PAM sequence: CTT
tgcctccagacagaaaaccc

SEQ ID NO: 16245 - DNA, 20 bp, Artificial Sequence
  Description of Artificial Sequence: Synthetic oligonucleotide
  Target: AGXT; (+) strand; PAM type: YTN; PAM sequence: TTT
gcctccagacagaaaacccc

SEQ ID NO: 16246 - DNA, 20 bp, Artificial Sequence
  Description of Artificial Sequence: Synthetic oligonucleotide
  Target: AGXT; (+) strand; PAM type: YTN; PAM sequence: TTG
cctccagacagaaaacccct

SEQ ID NO: 16247 - DNA, 20 bp, Artificial Sequence
  Description of Artificial Sequence: Synthetic oligonucleotide
  Target: AGXT; (+) strand; PAM type: YTN; PAM sequence: CTC
cagacagaaaaccccttcca

SEQ ID NO: 16248 - DNA, 20 bp, Artificial Sequence
  Description of Artificial Sequence: Synthetic oligonucleotide
  Target: AGXT; (+) strand; PAM type: YTN; PAM sequence: CTT
ccagccctctggactggacc

SEQ ID NO: 16249 - DNA, 20 bp, Artificial Sequence
  Description of Artificial Sequence: Synthetic oligonucleotide
  Target: AGXT; (+) strand; PAM type: YTN; PAM sequence: TTC
cagccctctggactggaccc

SEQ ID NO: 16250 - DNA, 20 bp, Artificial Sequence
  Description of Artificial Sequence: Synthetic oligonucleotide
  Target: AGXT; (+) strand; PAM type: YTN; PAM sequence: CTC
tggactggaccctttcaagt

SEQ ID NO: 16251 - DNA, 20 bp, Artificial Sequence
  Description of Artificial Sequence: Synthetic oligonucleotide
  Target: AGXT; (+) strand; PAM type: YTN; PAM sequence: CTG
gactggaccctttcaagtcc

SEQ ID NO: 16252 - DNA, 20 bp, Artificial Sequence
  Description of Artificial Sequence: Synthetic oligonucleotide
  Target: AGXT; (+) strand; PAM type: YTN; PAM sequence: CTG
gaccctttcaagtcctcata

SEQ ID NO: 16253 - DNA, 20 bp, Artificial Sequence
  Description of Artificial Sequence: Synthetic oligonucleotide
  Target: AGXT; (+) strand; PAM type: YTN; PAM sequence: CTT
tcaagtcctcatagcctctc

SEQ ID NO: 16254 - DNA, 20 bp, Artificial Sequence
  Description of Artificial Sequence: Synthetic oligonucleotide
  Target: AGXT; (+) strand; PAM type: YTN; PAM sequence: TTT
caagtcctcatagcctctcc

SEQ ID NO: 16255 - DNA, 20 bp, Artificial Sequence
  Description of Artificial Sequence: Synthetic oligonucleotide
  Target: AGXT; (+) strand; PAM type: YTN; PAM sequence: TTC
aagtcctcatagcctctccc

SEQ ID NO: 16256 - DNA, 20 bp, Artificial Sequence
  Description of Artificial Sequence: Synthetic oligonucleotide
  Target: AGXT; (+) strand; PAM type: YTN; PAM sequence: CTC
atagcctctcccacagctgt

SEQ ID NO: 16257 - DNA, 20 bp, Artificial Sequence
  Description of Artificial Sequence: Synthetic oligonucleotide
  Target: AGXT; (+) strand; PAM type: YTN; PAM sequence: CTC
tcccacagctgttaactgca

SEQ ID NO: 16258 - DNA, 20 bp, Artificial Sequence
  Description of Artificial Sequence: Synthetic oligonucleotide
  Target: AGXT; (+) strand; PAM type: YTN; PAM sequence: CTC
ccacagctgttaactgcagg

SEQ ID NO: 16259 - DNA, 20 bp, Artificial Sequence
  Description of Artificial Sequence: Synthetic oligonucleotide
  Target: AGXT; (+) strand; PAM type: YTN; PAM sequence: CTG
ttaactgcagggattctccc

SEQ ID NO: 16260 - DNA, 20 bp, Artificial Sequence
  Description of Artificial Sequence: Synthetic oligonucleotide
  Target: AGXT; (+) strand; PAM type: YTN; PAM sequence: TTA
actgcagggattctcccctt

SEQ ID NO: 16261 - DNA, 20 bp, Artificial Sequence
  Description of Artificial Sequence: Synthetic oligonucleotide
  Target: AGXT; (+) strand; PAM type: YTN; PAM sequence: CTG
cagggattctccccttgggt

SEQ ID NO: 16262 - DNA, 20 bp, Artificial Sequence
  Description of Artificial Sequence: Synthetic oligonucleotide
  Target: AGXT; (+) strand; PAM type: YTN; PAM sequence: TTC
tccccttgggtccacctttg

SEQ ID NO: 16263 - DNA, 20 bp, Artificial Sequence
  Description of Artificial Sequence: Synthetic oligonucleotide
  Target: AGXT; (+) strand; PAM type: YTN; PAM sequence: CTC
cccttgggtccacctttgcc

SEQ ID NO: 16264 - DNA, 20 bp, Artificial Sequence
  Description of Artificial Sequence: Synthetic oligonucleotide
  Target: AGXT; (+) strand; PAM type: YTN; PAM sequence: CTT
gggtccacctttgccacata

SEQ ID NO: 16265 - DNA, 20 bp, Artificial Sequence
  Description of Artificial Sequence: Synthetic oligonucleotide
  Target: AGXT; (+) strand; PAM type: YTN; PAM sequence: TTG
ggtccacctttgccacataa

SEQ ID NO: 16266 - DNA, 20 bp, Artificial Sequence
  Description of Artificial Sequence: Synthetic oligonucleotide
  Target: AGXT; (+) strand; PAM type: YTN; PAM sequence: CTT
tgccacataaagtctgtact

SEQ ID NO: 16267 - DNA, 20 bp, Artificial Sequence
  Description of Artificial Sequence: Synthetic oligonucleotide
  Target: AGXT; (+) strand; PAM type: YTN; PAM sequence: TTT
gccacataaagtctgtactg

SEQ ID NO: 16268 - DNA, 20 bp, Artificial Sequence
  Description of Artificial Sequence: Synthetic oligonucleotide
  Target: AGXT; (+) strand; PAM type: YTN; PAM sequence: TTG
ccacataaagtctgtactgc

SEQ ID NO: 16269 - DNA, 20 bp, Artificial Sequence
  Description of Artificial Sequence: Synthetic oligonucleotide
  Target: AGXT; (+) strand; PAM type: YTN; PAM sequence: CTG
tactgccgccagaactccag

SEQ ID NO: 16270 - DNA, 20 bp, Artificial Sequence
  Description of Artificial Sequence: Synthetic oligonucleotide
  Target: AGXT; (+) strand; PAM type: YTN; PAM sequence: CTG
ccgccagaactccagcctgc

SEQ ID NO: 16271 - DNA, 20 bp, Artificial Sequence
  Description of Artificial Sequence: Synthetic oligonucleotide
  Target: AGXT; (+) strand; PAM type: YTN; PAM sequence: CTC
cagcctgcttacactttgag

SEQ ID NO: 16272 - DNA, 20 bp, Artificial Sequence
  Description of Artificial Sequence: Synthetic oligonucleotide
  Target: AGXT; (+) strand; PAM type: YTN; PAM sequence: CTG
cttacactttgagcccttgg

SEQ ID NO: 16273 - DNA, 20 bp, Artificial Sequence
  Description of Artificial Sequence: Synthetic oligonucleotide
  Target: AGXT; (+) strand; PAM type: YTN; PAM sequence: CTT
acactttgagcccttggaag

SEQ ID NO: 16274 - DNA, 20 bp, Artificial Sequence
  Description of Artificial Sequence: Synthetic oligonucleotide
  Target: AGXT; (+) strand; PAM type: YTN; PAM sequence: TTA
cactttgagcccttggaaga

SEQ ID NO: 16275 - DNA, 20 bp, Artificial Sequence
  Description of Artificial Sequence: Synthetic oligonucleotide
  Target: AGXT; (+) strand; PAM type: YTN; PAM sequence: CTT
tgagcccttggaagatctat

SEQ ID NO: 16276 - DNA, 20 bp, Artificial Sequence
  Description of Artificial Sequence: Synthetic oligonucleotide
  Target: AGXT; (+) strand; PAM type: YTN; PAM sequence: TTT
gagcccttggaagatctatg

SEQ ID NO: 16277 - DNA, 20 bp, Artificial Sequence
  Description of Artificial Sequence: Synthetic oligonucleotide
  Target: AGXT; (+) strand; PAM type: YTN; PAM sequence: TTG
agcccttggaagatctatga

SEQ ID NO: 16278 - DNA, 20 bp, Artificial Sequence
  Description of Artificial Sequence: Synthetic oligonucleotide
  Target: AGXT; (+) strand; PAM type: YTN; PAM sequence: CTT
ggaagatctatgatttttgt

SEQ ID NO: 16279 - DNA, 20 bp, Artificial Sequence
  Description of Artificial Sequence: Synthetic oligonucleotide
  Target: AGXT; (+) strand; PAM type: YTN; PAM sequence: TTG
gaagatctatgatttttgtt

SEQ ID NO: 16280 - DNA, 20 bp, Artificial Sequence
  Description of Artificial Sequence: Synthetic oligonucleotide
  Target: AGXT; (+) strand; PAM type: YTN; PAM sequence: CTA
tgatttttgttttgcaaaca

SEQ ID NO: 16281 - DNA, 20 bp, Artificial Sequence
  Description of Artificial Sequence: Synthetic oligonucleotide
  Target: AGXT; (+) strand; PAM type: YTN; PAM sequence: TTT
ttgttttgcaaacaaccagg

SEQ ID NO: 16282 - DNA, 20 bp, Artificial Sequence
  Description of Artificial Sequence: Synthetic oligonucleotide
  Target: AGXT; (+) strand; PAM type: YTN; PAM sequence: TTT
tgttttgcaaacaaccaggt

SEQ ID NO: 16283 - DNA, 20 bp, Artificial Sequence
  Description of Artificial Sequence: Synthetic oligonucleotide
  Target: AGXT; (+) strand; PAM type: YTN; PAM sequence: TTT
gttttgcaaacaaccaggtg

SEQ ID NO: 16284 - DNA, 20 bp, Artificial Sequence
  Description of Artificial Sequence: Synthetic oligonucleotide
  Target: AGXT; (+) strand; PAM type: YTN; PAM sequence: TTG
ttttgcaaacaaccaggtga

SEQ ID NO: 16285 - DNA, 20 bp, Artificial Sequence
  Description of Artificial Sequence: Synthetic oligonucleotide
  Target: AGXT; (+) strand; PAM type: YTN; PAM sequence: TTT
tgcaaacaaccaggtgacac

SEQ ID NO: 16286 - DNA, 20 bp, Artificial Sequence
  Description of Artificial Sequence: Synthetic oligonucleotide
  Target: AGXT; (+) strand; PAM type: YTN; PAM sequence: TTT
gcaaacaaccaggtgacact

SEQ ID NO: 16287 - DNA, 20 bp, Artificial Sequence
  Description of Artificial Sequence: Synthetic oligonucleotide
  Target: AGXT; (+) strand; PAM type: YTN; PAM sequence: TTG
caaacaaccaggtgacacta

SEQ ID NO: 16288 - DNA, 20 bp, Artificial Sequence
  Description of Artificial Sequence: Synthetic oligonucleotide
  Target: AGXT; (+) strand; PAM type: YTN; PAM sequence: CTA
acctctcttcaaaagcaaag

SEQ ID NO: 16289 - DNA, 20 bp, Artificial Sequence
  Description of Artificial Sequence: Synthetic oligonucleotide
  Target: AGXT; (+) strand; PAM type: YTN; PAM sequence: CTC
tcttcaaaagcaaaggatac

SEQ ID NO: 16290 - DNA, 20 bp, Artificial Sequence
  Description of Artificial Sequence: Synthetic oligonucleotide
  Target: AGXT; (+) strand; PAM type: YTN; PAM sequence: CTC
ttcaaaagcaaaggatacca

SEQ ID NO: 16291 - DNA, 20 bp, Artificial Sequence
  Description of Artificial Sequence: Synthetic oligonucleotide
  Target: AGXT; (+) strand; PAM type: YTN; PAM sequence: CTT
caaaagcaaaggataccacg

SEQ ID NO: 16292 - DNA, 20 bp, Artificial Sequence
  Description of Artificial Sequence: Synthetic oligonucleotide
  Target: AGXT; (+) strand; PAM type: YTN; PAM sequence: TTC
aaaagcaaaggataccacgt

SEQ ID NO: 16293 - DNA, 20 bp, Artificial Sequence
  Description of Artificial Sequence: Synthetic oligonucleotide
  Target: AGXT; (+) strand; PAM type: YTN; PAM sequence: CTT
ttgctgtgtttatcattcac

SEQ ID NO: 16294 - DNA, 20 bp, Artificial Sequence
  Description of Artificial Sequence: Synthetic oligonucleotide
  Target: AGXT; (+) strand; PAM type: YTN; PAM sequence: TTT
tgctgtgtttatcattcact

SEQ ID NO: 16295 - DNA, 20 bp, Artificial Sequence
  Description of Artificial Sequence: Synthetic oligonucleotide
  Target: AGXT; (+) strand; PAM type: YTN; PAM sequence: TTT
gctgtgtttatcattcactt

SEQ ID NO: 16296 - DNA, 20 bp, Artificial Sequence
  Description of Artificial Sequence: Synthetic oligonucleotide
  Target: AGXT; (+) strand; PAM type: YTN; PAM sequence: TTG
ctgtgtttatcattcacttt

SEQ ID NO: 16297 - DNA, 20 bp, Artificial Sequence
  Description of Artificial Sequence: Synthetic oligonucleotide
  Target: AGXT; (+) strand; PAM type: YTN; PAM sequence: CTG
tgtttatcattcactttcct

SEQ ID NO: 16298 - DNA, 20 bp, Artificial Sequence
  Description of Artificial Sequence: Synthetic oligonucleotide
  Target: AGXT; (+) strand; PAM type: YTN; PAM sequence: TTT
atcattcactttcctttccc

SEQ ID NO: 16299 - DNA, 20 bp, Artificial Sequence
  Description of Artificial Sequence: Synthetic oligonucleotide
  Target: AGXT; (+) strand; PAM type: YTN; PAM sequence: TTA
tcattcactttcctttccct

SEQ ID NO: 16300 - DNA, 20 bp, Artificial Sequence
  Description of Artificial Sequence: Synthetic oligonucleotide
  Target: AGXT; (+) strand; PAM type: YTN; PAM sequence: TTC
actttcctttccctcccttg

SEQ ID NO: 16301 - DNA, 20 bp, Artificial Sequence
  Description of Artificial Sequence: Synthetic oligonucleotide
  Target: AGXT; (+) strand; PAM type: YTN; PAM sequence: CTT
tcctttccctcccttgtcat

SEQ ID NO: 16302 - DNA, 20 bp, Artificial Sequence
  Description of Artificial Sequence: Synthetic oligonucleotide
  Target: AGXT; (+) strand; PAM type: YTN; PAM sequence: TTT
cctttccctcccttgtcatt

SEQ ID NO: 16303 - DNA, 20 bp, Artificial Sequence
  Description of Artificial Sequence: Synthetic oligonucleotide
  Target: AGXT; (+) strand; PAM type: YTN; PAM sequence: TTC
ctttccctcccttgtcattc

SEQ ID NO: 16304 - DNA, 20 bp, Artificial Sequence
  Description of Artificial Sequence: Synthetic oligonucleotide
  Target: AGXT; (+) strand; PAM type: YTN; PAM sequence: CTT
tccctcccttgtcattcatt

SEQ ID NO: 16305 - DNA, 20 bp, Artificial Sequence
  Description of Artificial Sequence: Synthetic oligonucleotide
  Target: AGXT; (+) strand; PAM type: YTN; PAM sequence: TTT
ccctcccttgtcattcattt

SEQ ID NO: 16306 - DNA, 20 bp, Artificial Sequence
  Description of Artificial Sequence: Synthetic oligonucleotide
  Target: AGXT; (+) strand; PAM type: YTN; PAM sequence: TTC
cctcccttgtcattcatttc

SEQ ID NO: 16307 - DNA, 20 bp, Artificial Sequence
  Description of Artificial Sequence: Synthetic oligonucleotide
  Target: AGXT; (+) strand; PAM type: YTN; PAM sequence: CTC
ccttgtcattcatttcctta

SEQ ID NO: 16308 - DNA, 20 bp, Artificial Sequence
  Description of Artificial Sequence: Synthetic oligonucleotide
  Target: AGXT; (+) strand; PAM type: YTN; PAM sequence: CTT
gtcattcatttccttatgta

SEQ ID NO: 16309 - DNA, 20 bp, Artificial Sequence
  Description of Artificial Sequence: Synthetic oligonucleotide
  Target: AGXT; (+) strand; PAM type: YTN; PAM sequence: TTG
tcattcatttccttatgtac

SEQ ID NO: 16310 - DNA, 20 bp, Artificial Sequence
  Description of Artificial Sequence: Synthetic oligonucleotide
  Target: AGXT; (+) strand; PAM type: YTN; PAM sequence: TTC
atttccttatgtactctaga

SEQ ID NO: 16311 - DNA, 20 bp, Artificial Sequence
  Description of Artificial Sequence: Synthetic oligonucleotide
  Target: AGXT; (+) strand; PAM type: YTN; PAM sequence: TTT
ccttatgtactctagaagcg

SEQ ID NO: 16312 - DNA, 20 bp, Artificial Sequence
  Description of Artificial Sequence: Synthetic oligonucleotide
  Target: AGXT; (+) strand; PAM type: YTN; PAM sequence: TTC
cttatgtactctagaagcgt

SEQ ID NO: 16313 - DNA, 20 bp, Artificial Sequence
  Description of Artificial Sequence: Synthetic oligonucleotide
  Target: AGXT; (+) strand; PAM type: YTN; PAM sequence: CTT
atgtactctagaagcgtttt

SEQ ID NO: 16314 - DNA, 20 bp, Artificial Sequence
  Description of Artificial Sequence: Synthetic oligonucleotide
  Target: AGXT; (+) strand; PAM type: YTN; PAM sequence: TTA
tgtactctagaagcgttttt

SEQ ID NO: 16315 - DNA, 20 bp, Artificial Sequence
  Description of Artificial Sequence: Synthetic oligonucleotide
  Target: AGXT; (+) strand; PAM type: YTN; PAM sequence: CTC
tagaagcgtttttaggtcct

SEQ ID NO: 16316 - DNA, 20 bp, Artificial Sequence
  Description of Artificial Sequence: Synthetic oligonucleotide
  Target: AGXT; (+) strand; PAM type: YTN; PAM sequence: CTA
gaagcgtttttaggtcctcc

SEQ ID NO: 16317 - DNA, 20 bp, Artificial Sequence
  Description of Artificial Sequence: Synthetic oligonucleotide
  Target: AGXT; (+) strand; PAM type: YTN; PAM sequence: TTT
ttaggtcctccaattttctg

SEQ ID NO: 16318 - DNA, 20 bp, Artificial Sequence
  Description of Artificial Sequence: Synthetic oligonucleotide
  Target: AGXT; (+) strand; PAM type: YTN; PAM sequence: TTT
taggtcctccaattttctga

SEQ ID NO: 16319 - DNA, 20 bp, Artificial Sequence
  Description of Artificial Sequence: Synthetic oligonucleotide
  Target: AGXT; (+) strand; PAM type: YTN; PAM sequence: TTT
aggtcctccaattttctgag

SEQ ID NO: 16320 - DNA, 20 bp, Artificial Sequence
  Description of Artificial Sequence: Synthetic oligonucleotide
  Target: AGXT; (+) strand; PAM type: YTN; PAM sequence: TTA
ggtcctccaattttctgaga

SEQ ID NO: 16321 - DNA, 20 bp, Artificial Sequence
  Description of Artificial Sequence: Synthetic oligonucleotide
  Target: AGXT; (+) strand; PAM type: YTN; PAM sequence: CTC
caattttctgagattatcct

SEQ ID NO: 16322 - DNA, 20 bp, Artificial Sequence
  Description of Artificial Sequence: Synthetic oligonucleotide
  Target: AGXT; (+) strand; PAM type: YTN; PAM sequence: TTT
tctgagattatcctcaattc

SEQ ID NO: 16323 - DNA, 20 bp, Artificial Sequence
  Description of Artificial Sequence: Synthetic oligonucleotide
  Target: AGXT; (+) strand; PAM type: YTN; PAM sequence: TTT
ctgagattatcctcaattca

SEQ ID NO: 16324 - DNA, 20 bp, Artificial Sequence
  Description of Artificial Sequence: Synthetic oligonucleotide
  Target: AGXT; (+) strand; PAM type: YTN; PAM sequence: TTC
tgagattatcctcaattcac

SEQ ID NO: 16325 - DNA, 20 bp, Artificial Sequence
  Description of Artificial Sequence: Synthetic oligonucleotide
  Target: AGXT; (+) strand; PAM type: YTN; PAM sequence: CTG
agattatcctcaattcactt

SEQ ID NO: 16326 - DNA, 20 bp, Artificial Sequence
  Description of Artificial Sequence: Synthetic oligonucleotide
  Target: AGXT; (+) strand; PAM type: YTN; PAM sequence: TTA
tcctcaattcacttactttt

SEQ ID NO: 16327 - DNA, 20 bp, Artificial Sequence
  Description of Artificial Sequence: Synthetic oligonucleotide
  Target: AGXT; (+) strand; PAM type: YTN; PAM sequence: CTC
aattcacttacttttttttt

SEQ ID NO: 16328 - DNA, 20 bp, Artificial Sequence
  Description of Artificial Sequence: Synthetic oligonucleotide
  Target: AGXT; (+) strand; PAM type: YTN; PAM sequence: TTC
acttactttttttttttttt

SEQ ID NO: 16329 - DNA, 20 bp, Artificial Sequence
  Description of Artificial Sequence: Synthetic oligonucleotide
  Target: AGXT; (+) strand; PAM type: YTN; PAM sequence: CTT
actttttttttttttttttt

SEQ ID NO: 16330 - DNA, 20 bp, Artificial Sequence
  Description of Artificial Sequence: Synthetic oligonucleotide
  Target: AGXT; (+) strand; PAM type: YTN; PAM sequence: TTA
cttttttttttttttttttt

SEQ ID NO: 16331 - DNA, 20 bp, Artificial Sequence
  Description of Artificial Sequence: Synthetic oligonucleotide
  Target: AGXT; (+) strand; PAM type: YTN; PAM sequence: CTT
tttttttttttttttttttg

SEQ ID NO: 16332 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttttga

SEQ ID NO: 16333 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttgag

SEQ ID NO: 16334 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttgaga

SEQ ID NO: 16335 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttgagac

SEQ ID NO: 16336 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttgagaca

SEQ ID NO: 16337 - DNA, 20 bp, Artificial Sequence
  Description of Artificial Sequence: Synthetic oligonucleotide
  Target: AGXT; (+) strand; PAM type: YTN; PAM sequence: TTT
tttttttttttttgagacag

SEQ ID NO: 16338 - DNA, 20 bp, Artificial Sequence
  Description of Artificial Sequence: Synthetic oligonucleotide
  Target: AGXT; (+) strand; PAM type: YTN; PAM sequence: TTT
ttttttttttttgagacaga

SEQ ID NO: 16339 - DNA, 20 bp, Artificial Sequence
  Description of Artificial Sequence: Synthetic oligonucleotide
  Target: AGXT; (+) strand; PAM type: YTN; PAM sequence: TTT
tttttttttttgagacagag

SEQ ID NO: 16340 - DNA, 20 bp, Artificial Sequence
  Description of Artificial Sequence: Synthetic oligonucleotide
  Target: AGXT; (+) strand; PAM type: YTN; PAM sequence: TTT
ttttttttttgagacagagt

SEQ ID NO: 16341 - DNA, 20 bp, Artificial Sequence
  Description of Artificial Sequence: Synthetic oligonucleotide
  Target: AGXT; (+) strand; PAM type: YTN; PAM sequence: TTT
tttttttttgagacagagtt

SEQ ID NO: 16342 - DNA, 20 bp, Artificial Sequence
  Description of Artificial Sequence: Synthetic oligonucleotide
  Target: AGXT; (+) strand; PAM type: YTN; PAM sequence: TTT
ttttttttgagacagagttt

SEQ ID NO: 16343 - DNA, 20 bp, Artificial Sequence
  Description of Artificial Sequence: Synthetic oligonucleotide
  Target: AGXT; (+) strand; PAM type: YTN; PAM sequence: TTT
tttttttgagacagagtttt

SEQ ID NO: 16344 - DNA, 20 bp, Artificial Sequence
  Description of Artificial Sequence: Synthetic oligonucleotide
  Target: AGXT; (+) strand; PAM type: YTN; PAM sequence: TTT
ttttttgagacagagttttg

SEQ ID NO: 16345 - DNA, 20 bp, Artificial Sequence
  Description of Artificial Sequence: Synthetic oligonucleotide
  Target: AGXT; (+) strand; PAM type: YTN; PAM sequence: TTT
tttttgagacagagttttgc

SEQ ID NO: 16346 - DNA, 20 bp, Artificial Sequence
  Description of Artificial Sequence: Synthetic oligonucleotide
  Target: AGXT; (+) strand; PAM type: YTN; PAM sequence: TTT
ttttgagacagagttttgct

SEQ ID NO: 16347 - DNA, 20 bp, Artificial Sequence
  Description of Artificial Sequence: Synthetic oligonucleotide
  Target: AGXT; (+) strand; PAM type: YTN; PAM sequence: TTT
tttgagacagagttttgctc

SEQ ID NO: 16348 - DNA, 20 bp, Artificial Sequence
  Description of Artificial Sequence: Synthetic oligonucleotide
  Target: AGXT; (+) strand; PAM type: YTN; PAM sequence: TTT
ttgagacagagttttgctct

SEQ ID NO: 16349 - DNA, 20 bp, Artificial Sequence
  Description of Artificial Sequence: Synthetic oligonucleotide
  Target: AGXT; (+) strand; PAM type: YTN; PAM sequence: TTT
tgagacagagttttgctctt

SEQ ID NO: 16350 - DNA, 20 bp, Artificial Sequence
  Description of Artificial Sequence: Synthetic oligonucleotide
  Target: AGXT; (+) strand; PAM type: YTN; PAM sequence: TTT
gagacagagttttgctcttg

SEQ ID NO: 16351 - DNA, 20 bp, Artificial Sequence
  Description of Artificial Sequence: Synthetic oligonucleotide
  Target: AGXT; (+) strand; PAM type: YTN; PAM sequence: TTG
agacagagttttgctcttgt

SEQ ID NO: 16352 - DNA, 20 bp, Artificial Sequence
  Description of Artificial Sequence: Synthetic oligonucleotide
  Target: AGXT; (+) strand; PAM type: YTN; PAM sequence: TTT
tgctcttgtcacccaggcta

SEQ ID NO: 16353 - DNA, 20 bp, Artificial Sequence
  Description of Artificial Sequence: Synthetic oligonucleotide
  Target: AGXT; (+) strand; PAM type: YTN; PAM sequence: TTT
gctcttgtcacccaggctat

SEQ ID NO: 16354 - DNA, 20 bp, Artificial Sequence
  Description of Artificial Sequence: Synthetic oligonucleotide
  Target: AGXT; (+) strand; PAM type: YTN; PAM sequence: TTG
ctcttgtcacccaggctata

SEQ ID NO: 16355 - DNA, 20 bp, Artificial Sequence
  Description of Artificial Sequence: Synthetic oligonucleotide
  Target: AGXT; (+) strand; PAM type: YTN; PAM sequence: CTC
ttgtcacccaggctatagtg

SEQ ID NO: 16356 - DNA, 20 bp, Artificial Sequence
  Description of Artificial Sequence: Synthetic oligonucleotide
  Target: AGXT; (+) strand; PAM type: YTN; PAM sequence: CTT
gtcacccaggctatagtgca

SEQ ID NO: 16357 - DNA, 20 bp, Artificial Sequence
  Description of Artificial Sequence: Synthetic oligonucleotide
  Target: AGXT; (+) strand; PAM type: YTN; PAM sequence: TTG
tcacccaggctatagtgcaa

SEQ ID NO: 16358 - DNA, 20 bp, Artificial Sequence
  Description of Artificial Sequence: Synthetic oligonucleotide
  Target: AGXT; (+) strand; PAM type: YTN; PAM sequence: CTA
tagtgcaatggtgcgatctc

SEQ ID NO: 16359 - DNA, 20 bp, Artificial Sequence
  Description of Artificial Sequence: Synthetic oligonucleotide
  Target: AGXT; (+) strand; PAM type: YTN; PAM sequence: CTC
ggctcactgcaaccgccatc

SEQ ID NO: 16360 - DNA, 20 bp, Artificial Sequence
  Description of Artificial Sequence: Synthetic oligonucleotide
  Target: AGXT; (+) strand; PAM type: YTN; PAM sequence: CTC
actgcaaccgccatctcccg

SEQ ID NO: 16361 - DNA, 20 bp, Artificial Sequence
  Description of Artificial Sequence: Synthetic oligonucleotide
  Target: AGXT; (+) strand; PAM type: YTN; PAM sequence: CTG
caaccgccatctcccgggtt

SEQ ID NO: 16362 - DNA, 20 bp, Artificial Sequence
  Description of Artificial Sequence: Synthetic oligonucleotide
  Target: AGXT; (+) strand; PAM type: YTN; PAM sequence: CTC
ccgggttcaagtgattctcc

SEQ ID NO: 16363 - DNA, 20 bp, Artificial Sequence
  Description of Artificial Sequence: Synthetic oligonucleotide
  Target: AGXT; (+) strand; PAM type: YTN; PAM sequence: TTC
aagtgattctcccgcctcaa

SEQ ID NO: 16364 - DNA, 20 bp, Artificial Sequence
  Description of Artificial Sequence: Synthetic oligonucleotide
  Target: AGXT; (+) strand; PAM type: YTN; PAM sequence: TTC
tcccgcctcaacctcctgag

SEQ ID NO: 16365 - DNA, 20 bp, Artificial Sequence
  Description of Artificial Sequence: Synthetic oligonucleotide
  Target: AGXT; (+) strand; PAM type: YTN; PAM sequence: CTC
ccgcctcaacctcctgagta

SEQ ID NO: 16366 - DNA, 20 bp, Artificial Sequence
  Description of Artificial Sequence: Synthetic oligonucleotide
  Target: AGXT; (+) strand; PAM type: YTN; PAM sequence: CTC
aacctcctgagtagctggga

SEQ ID NO: 16367 - DNA, 20 bp, Artificial Sequence
  Description of Artificial Sequence: Synthetic oligonucleotide
  Target: AGXT; (+) strand; PAM type: YTN; PAM sequence: CTC
ctgagtagctgggattacag

SEQ ID NO: 16368 - DNA, 20 bp, Artificial Sequence
  Description of Artificial Sequence: Synthetic oligonucleotide
  Target: AGXT; (+) strand; PAM type: YTN; PAM sequence: CTG
agtagctgggattacaggca

SEQ ID NO: 16369 - DNA, 20 bp, Artificial Sequence
  Description of Artificial Sequence: Synthetic oligonucleotide
  Target: AGXT; (+) strand; PAM type: YTN; PAM sequence: CTG
ggattacaggcatgcaccac

SEQ ID NO: 16370 - DNA, 20 bp, Artificial Sequence
  Description of Artificial Sequence: Synthetic oligonucleotide
  Target: AGXT; (+) strand; PAM type: YTN; PAM sequence: TTA
caggcatgcaccaccatgcc

SEQ ID NO: 16371 - DNA, 20 bp, Artificial Sequence
  Description of Artificial Sequence: Synthetic oligonucleotide
  Target: AGXT; (+) strand; PAM type: YTN; PAM sequence: CTA
tttttttttttttttttttt

SEQ ID NO: 16372 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 16373 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 16374 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 16375 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttg

SEQ ID NO: 16376 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttttgt

SEQ ID NO: 16377 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttgta

SEQ ID NO: 16378 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttgtat

SEQ ID NO: 16379 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttgtatt

SEQ ID NO: 16380 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttgtattt

SEQ ID NO: 16381 - DNA, 20 bp, Artificial Sequence
  Description of Artificial Sequence: Synthetic oligonucleotide
  Target: AGXT; (+) strand; PAM type: YTN; PAM sequence: TTT
tttttttttttttgtatttt

SEQ ID NO: 16382 - DNA, 20 bp, Artificial Sequence
  Description of Artificial Sequence: Synthetic oligonucleotide
  Target: AGXT; (+) strand; PAM type: YTN; PAM sequence: TTT
ttttttttttttgtattttt

SEQ ID NO: 16383 - DNA, 20 bp, Artificial Sequence
  Description of Artificial Sequence: Synthetic oligonucleotide
  Target: AGXT; (+) strand; PAM type: YTN; PAM sequence: TTT
tttttttttttgtattttta

SEQ ID NO: 16384 - DNA, 20 bp, Artificial Sequence
  Description of Artificial Sequence: Synthetic oligonucleotide
  Target: AGXT; (+) strand; PAM type: YTN; PAM sequence: TTT
ttttttttttgtatttttag

SEQ ID NO: 16385 - DNA, 20 bp, Artificial Sequence
  Description of Artificial Sequence: Synthetic oligonucleotide
  Target: AGXT; (+) strand; PAM type: YTN; PAM sequence: TTT
tttttttttgtatttttagt

SEQ ID NO: 16386 - DNA, 20 bp, Artificial Sequence
  Description of Artificial Sequence: Synthetic oligonucleotide
  Target: AGXT; (+) strand; PAM type: YTN; PAM sequence: TTT
ttttttttgtatttttagta

SEQ ID NO: 16387 - DNA, 20 bp, Artificial Sequence
  Description of Artificial Sequence: Synthetic oligonucleotide
  Target: AGXT; (+) strand; PAM type: YTN; PAM sequence: TTT
tttttttgtatttttagtag

SEQ ID NO: 16388 - DNA, 20 bp, Artificial Sequence
  Description of Artificial Sequence: Synthetic oligonucleotide
  Target: AGXT; (+) strand; PAM type: YTN; PAM sequence: TTT
ttttttgtatttttagtaga

SEQ ID NO: 16389 - DNA, 20 bp, Artificial Sequence
  Description of Artificial Sequence: Synthetic oligonucleotide
  Target: AGXT; (+) strand; PAM type: YTN; PAM sequence: TTT
tttttgtatttttagtagag

SEQ ID NO: 16390 - DNA, 20 bp, Artificial Sequence
  Description of Artificial Sequence: Synthetic oligonucleotide
  Target: AGXT; (+) strand; PAM type: YTN; PAM sequence: TTT
ttttgtatttttagtagaga

SEQ ID NO: 16391 - DNA, 20 bp, Artificial Sequence
  Description of Artificial Sequence: Synthetic oligonucleotide
  Target: AGXT; (+) strand; PAM type: YTN; PAM sequence: TTT
tttgtatttttagtagagac

SEQ ID NO: 16392 - DNA, 20 bp, Artificial Sequence
  Description of Artificial Sequence: Synthetic oligonucleotide
  Target: AGXT; (+) strand; PAM type: YTN; PAM sequence: TTT
ttgtatttttagtagagaca

SEQ ID NO: 16393 - DNA, 20 bp, Artificial Sequence
  Description of Artificial Sequence: Synthetic oligonucleotide
  Target: AGXT; (+) strand; PAM type: YTN; PAM sequence: TTT
tgtatttttagtagagacag

SEQ ID NO: 16394 - DNA, 20 bp, Artificial Sequence
  Description of Artificial Sequence: Synthetic oligonucleotide
  Target: AGXT; (+) strand; PAM type: YTN; PAM sequence: TTT
gtatttttagtagagacagg

SEQ ID NO: 16395 - DNA, 20 bp, Artificial Sequence
  Description of Artificial Sequence: Synthetic oligonucleotide
  Target: AGXT; (+) strand; PAM type: YTN; PAM sequence: TTG
tatttttagtagagacaggg

SEQ ID NO: 16396 - DNA, 20 bp, Artificial Sequence
  Description of Artificial Sequence: Synthetic oligonucleotide
  Target: AGXT; (+) strand; PAM type: YTN; PAM sequence: TTT
ttagtagagacagggtttca

SEQ ID NO: 16397 - DNA, 20 bp, Artificial Sequence
  Description of Artificial Sequence: Synthetic oligonucleotide
  Target: AGXT; (+) strand; PAM type: YTN; PAM sequence: TTT
tagtagagacagggtttcac

SEQ ID NO: 16398 - DNA, 20 bp, Artificial Sequence
  Description of Artificial Sequence: Synthetic oligonucleotide
  Target: AGXT; (+) strand; PAM type: YTN; PAM sequence: TTT
agtagagacagggtttcacc

SEQ ID NO: 16399 - DNA, 20 bp, Artificial Sequence
  Description of Artificial Sequence: Synthetic oligonucleotide
  Target: AGXT; (+) strand; PAM type: YTN; PAM sequence: TTA
gtagagacagggtttcacca

SEQ ID NO: 16400 - DNA, 20 bp, Artificial Sequence
  Description of Artificial Sequence: Synthetic oligonucleotide
  Target: AGXT; (+) strand; PAM type: YTN; PAM sequence: TTT
caccatgttggccaggctgt

SEQ ID NO: 16401 - DNA, 20 bp, Artificial Sequence
  Description of Artificial Sequence: Synthetic oligonucleotide
  Target: AGXT; (+) strand; PAM type: YTN; PAM sequence: TTC
accatgttggccaggctgtt

SEQ ID NO: 16402 - DNA, 20 bp, Artificial Sequence
  Description of Artificial Sequence: Synthetic oligonucleotide
  Target: AGXT; (+) strand; PAM type: YTN; PAM sequence: TTG
gccaggctgttctcacactt

SEQ ID NO: 16403 - DNA, 20 bp, Artificial Sequence
  Description of Artificial Sequence: Synthetic oligonucleotide
  Target: AGXT; (+) strand; PAM type: YTN; PAM sequence: CTG
ttctcacacttctgacctca

SEQ ID NO: 16404 - DNA, 20 bp, Artificial Sequence
  Description of Artificial Sequence: Synthetic oligonucleotide
  Target: AGXT; (+) strand; PAM type: YTN; PAM sequence: TTC
tcacacttctgacctcaggt

SEQ ID NO: 16405 - DNA, 20 bp, Artificial Sequence
  Description of Artificial Sequence: Synthetic oligonucleotide
  Target: AGXT; (+) strand; PAM type: YTN; PAM sequence: CTC
acacttctgacctcaggtga

SEQ ID NO: 16406 - DNA, 20 bp, Artificial Sequence
  Description of Artificial Sequence: Synthetic oligonucleotide
  Target: AGXT; (+) strand; PAM type: YTN; PAM sequence: CTT
ctgacctcaggtgatccgcc

SEQ ID NO: 16407 - DNA, 20 bp, Artificial Sequence
  Description of Artificial Sequence: Synthetic oligonucleotide
  Target: AGXT; (+) strand; PAM type: YTN; PAM sequence: TTC
tgacctcaggtgatccgccc

SEQ ID NO: 16408 - DNA, 20 bp, Artificial Sequence
  Description of Artificial Sequence: Synthetic oligonucleotide
  Target: AGXT; (+) strand; PAM type: YTN; PAM sequence: CTG
acctcaggtgatccgcccgt

SEQ ID NO: 16409 - DNA, 20 bp, Artificial Sequence
  Description of Artificial Sequence: Synthetic oligonucleotide
  Target: AGXT; (+) strand; PAM type: YTN; PAM sequence: CTC
aggtgatccgcccgtctcag

SEQ ID NO: 16410 - DNA, 20 bp, Artificial Sequence
  Description of Artificial Sequence: Synthetic oligonucleotide
  Target: AGXT; (+) strand; PAM type: YTN; PAM sequence: CTC
agcctcccaaagtgctggaa

SEQ ID NO: 16411 - DNA, 20 bp, Artificial Sequence
  Description of Artificial Sequence: Synthetic oligonucleotide
  Target: AGXT; (+) strand; PAM type: YTN; PAM sequence: CTC
ccaaagtgctggaattacag

SEQ ID NO: 16412 - DNA, 20 bp, Artificial Sequence
  Description of Artificial Sequence: Synthetic oligonucleotide
  Target: AGXT; (+) strand; PAM type: YTN; PAM sequence: CTG
gaattacaggcatgagccac

SEQ ID NO: 16413 - DNA, 20 bp, Artificial Sequence
  Description of Artificial Sequence: Synthetic oligonucleotide
  Target: AGXT; (+) strand; PAM type: YTN; PAM sequence: TTA
caggcatgagccaccacacc

SEQ ID NO: 16414 - DNA, 20 bp, Artificial Sequence
  Description of Artificial Sequence: Synthetic oligonucleotide
  Target: AGXT; (+) strand; PAM type: YTN; PAM sequence: TTT
actgtctctttatccaatcc

SEQ ID NO: 16415 - DNA, 20 bp, Artificial Sequence
  Description of Artificial Sequence: Synthetic oligonucleotide
  Target: AGXT; (+) strand; PAM type: YTN; PAM sequence: TTA
ctgtctctttatccaatccc

SEQ ID NO: 16416 - DNA, 20 bp, Artificial Sequence
  Description of Artificial Sequence: Synthetic oligonucleotide
  Target: AGXT; (+) strand; PAM type: YTN; PAM sequence: CTG
tctctttatccaatccccat

SEQ ID NO: 16417 - DNA, 20 bp, Artificial Sequence
  Description of Artificial Sequence: Synthetic oligonucleotide
  Target: AGXT; (+) strand; PAM type: YTN; PAM sequence: CTC
tttatccaatccccatttct

SEQ ID NO: 16418 - DNA, 20 bp, Artificial Sequence
  Description of Artificial Sequence: Synthetic oligonucleotide
  Target: AGXT; (+) strand; PAM type: YTN; PAM sequence: CTT
tatccaatccccatttctca

SEQ ID NO: 16419 - DNA, 20 bp, Artificial Sequence
  Description of Artificial Sequence: Synthetic oligonucleotide
  Target: AGXT; (+) strand; PAM type: YTN; PAM sequence: TTT
atccaatccccatttctcaa

SEQ ID NO: 16420 - DNA, 20 bp, Artificial Sequence
  Description of Artificial Sequence: Synthetic oligonucleotide
  Target: AGXT; (+) strand; PAM type: YTN; PAM sequence: TTA
tccaatccccatttctcaag

SEQ ID NO: 16421 - DNA, 20 bp, Artificial Sequence
  Description of Artificial Sequence: Synthetic oligonucleotide
  Target: AGXT; (+) strand; PAM type: YTN; PAM sequence: TTT
ctcaagacccacatacaatt

SEQ ID NO: 16422 - DNA, 20 bp, Artificial Sequence
  Description of Artificial Sequence: Synthetic oligonucleotide
  Target: AGXT; (+) strand; PAM type: YTN; PAM sequence: TTC
tcaagacccacatacaatta

SEQ ID NO: 16423 - DNA, 20 bp, Artificial Sequence
  Description of Artificial Sequence: Synthetic oligonucleotide
  Target: AGXT; (+) strand; PAM type: YTN; PAM sequence: CTC
aagacccacatacaattatt

SEQ ID NO: 16424 - DNA, 20 bp, Artificial Sequence
  Description of Artificial Sequence: Synthetic oligonucleotide
  Target: AGXT; (+) strand; PAM type: YTN; PAM sequence: TTA
ttcagcttgcactagatttt

SEQ ID NO: 16425 - DNA, 20 bp, Artificial Sequence
  Description of Artificial Sequence: Synthetic oligonucleotide
  Target: AGXT; (+) strand; PAM type: YTN; PAM sequence: TTC
agcttgcactagatttttat

SEQ ID NO: 16426 - DNA, 20 bp, Artificial Sequence
  Description of Artificial Sequence: Synthetic oligonucleotide
  Target: AGXT; (+) strand; PAM type: YTN; PAM sequence: CTT
gcactagatttttatttgca

SEQ ID NO: 16427 - DNA, 20 bp, Artificial Sequence
  Description of Artificial Sequence: Synthetic oligonucleotide
  Target: AGXT; (+) strand; PAM type: YTN; PAM sequence: TTG
cactagatttttatttgcag

SEQ ID NO: 16428 - DNA, 20 bp, Artificial Sequence
  Description of Artificial Sequence: Synthetic oligonucleotide
  Target: AGXT; (+) strand; PAM type: YTN; PAM sequence: CTA
gatttttatttgcagggtgg

SEQ ID NO: 16429 - DNA, 20 bp, Artificial Sequence
  Description of Artificial Sequence: Synthetic oligonucleotide
  Target: AGXT; (+) strand; PAM type: YTN; PAM sequence: TTT
ttatttgcagggtggttttt

SEQ ID NO: 16430 - DNA, 20 bp, Artificial Sequence
  Description of Artificial Sequence: Synthetic oligonucleotide
  Target: AGXT; (+) strand; PAM type: YTN; PAM sequence: TTT
tatttgcagggtggtttttc

SEQ ID NO: 16431 - DNA, 20 bp, Artificial Sequence
  Description of Artificial Sequence: Synthetic oligonucleotide
  Target: AGXT; (+) strand; PAM type: YTN; PAM sequence: TTT
atttgcagggtggtttttct

SEQ ID NO: 16432 - DNA, 20 bp, Artificial Sequence
  Description of Artificial Sequence: Synthetic oligonucleotide
  Target: AGXT; (+) strand; PAM type: YTN; PAM sequence: TTA
tttgcagggtggtttttcta

SEQ ID NO: 16433 - DNA, 20 bp, Artificial Sequence
  Description of Artificial Sequence: Synthetic oligonucleotide
  Target: AGXT; (+) strand; PAM type: YTN; PAM sequence: TTT
gcagggtggtttttctaatt

SEQ ID NO: 16434 - DNA, 20 bp, Artificial Sequence
  Description of Artificial Sequence: Synthetic oligonucleotide
  Target: AGXT; (+) strand; PAM type: YTN; PAM sequence: TTG
cagggtggtttttctaatta

SEQ ID NO: 16435 - DNA, 20 bp, Artificial Sequence
  Description of Artificial Sequence: Synthetic oligonucleotide
  Target: AGXT; (+) strand; PAM type: YTN; PAM sequence: TTT
ttctaattatacttggagca

SEQ ID NO: 16436 - DNA, 20 bp, Artificial Sequence
  Description of Artificial Sequence: Synthetic oligonucleotide
  Target: AGXT; (+) strand; PAM type: YTN; PAM sequence: TTT
tctaattatacttggagcaa

SEQ ID NO: 16437 - DNA, 20 bp, Artificial Sequence
  Description of Artificial Sequence: Synthetic oligonucleotide
  Target: AGXT; (+) strand; PAM type: YTN; PAM sequence: TTT
ctaattatacttggagcaac

SEQ ID NO: 16438 - DNA, 20 bp, Artificial Sequence
  Description of Artificial Sequence: Synthetic oligonucleotide
  Target: AGXT; (+) strand; PAM type: YTN; PAM sequence: TTC
taattatacttggagcaact

SEQ ID NO: 16439 - DNA, 20 bp, Artificial Sequence
  Description of Artificial Sequence: Synthetic oligonucleotide
  Target: AGXT; (+) strand; PAM type: YTN; PAM sequence: CTA
attatacttggagcaacttt

SEQ ID NO: 16440 - DNA, 20 bp, Artificial Sequence
  Description of Artificial Sequence: Synthetic oligonucleotide
  Target: AGXT; (+) strand; PAM type: YTN; PAM sequence: TTA
tacttggagcaacttttgta

SEQ ID NO: 16441 - DNA, 20 bp, Artificial Sequence
  Description of Artificial Sequence: Synthetic oligonucleotide
  Target: AGXT; (+) strand; PAM type: YTN; PAM sequence: CTT
ggagcaacttttgtaacagt

SEQ ID NO: 16442 - DNA, 20 bp, Artificial Sequence
  Description of Artificial Sequence: Synthetic oligonucleotide
  Target: AGXT; (+) strand; PAM type: YTN; PAM sequence: TTG
gagcaacttttgtaacagtc

SEQ ID NO: 16443 - DNA, 20 bp, Artificial Sequence
  Description of Artificial Sequence: Synthetic oligonucleotide
  Target: AGXT; (+) strand; PAM type: YTN; PAM sequence: CTT
ttgtaacagtccttgaatta

SEQ ID NO: 16444 - DNA, 20 bp, Artificial Sequence
  Description of Artificial Sequence: Synthetic oligonucleotide
  Target: AGXT; (+) strand; PAM type: YTN; PAM sequence: TTT
tgtaacagtccttgaattag

SEQ ID NO: 16445 - DNA, 20 bp, Artificial Sequence
  Description of Artificial Sequence: Synthetic oligonucleotide
  Target: AGXT; (+) strand; PAM type: YTN; PAM sequence: TTT
gtaacagtccttgaattaga

SEQ ID NO: 16446 - DNA, 20 bp, Artificial Sequence
  Description of Artificial Sequence: Synthetic oligonucleotide
  Target: AGXT; (+) strand; PAM type: YTN; PAM sequence: TTG
taacagtccttgaattagaa

SEQ ID NO: 16447 - DNA, 20 bp, Artificial Sequence
  Description of Artificial Sequence: Synthetic oligonucleotide
  Target: AGXT; (+) strand; PAM type: YTN; PAM sequence: CTT
gaattagaacaatgagactc

SEQ ID NO: 16448 - DNA, 20 bp, Artificial Sequence
  Description of Artificial Sequence: Synthetic oligonucleotide
  Target: AGXT; (+) strand; PAM type: YTN; PAM sequence: TTG
aattagaacaatgagactcc

SEQ ID NO: 16449 - DNA, 20 bp, Artificial Sequence
  Description of Artificial Sequence: Synthetic oligonucleotide
  Target: AGXT; (+) strand; PAM type: YTN; PAM sequence: TTA
gaacaatgagactccttttt

SEQ ID NO: 16450 - DNA, 20 bp, Artificial Sequence
  Description of Artificial Sequence: Synthetic oligonucleotide
  Target: AGXT; (+) strand; PAM type: YTN; PAM sequence: CTC
cttttttctttctttcatgt

SEQ ID NO: 16451 - DNA, 20 bp, Artificial Sequence
  Description of Artificial Sequence: Synthetic oligonucleotide
  Target: AGXT; (+) strand; PAM type: YTN; PAM sequence: CTT
ttttctttctttcatgtttt

SEQ ID NO: 16452 - DNA, 20 bp, Artificial Sequence
  Description of Artificial Sequence: Synthetic oligonucleotide
  Target: AGXT; (+) strand; PAM type: YTN; PAM sequence: TTT
tttctttctttcatgttttt

SEQ ID NO: 16453 - DNA, 20 bp, Artificial Sequence
  Description of Artificial Sequence: Synthetic oligonucleotide
  Target: AGXT; (+) strand; PAM type: YTN; PAM sequence: TTT
ttctttctttcatgtttttc

SEQ ID NO: 16454 - DNA, 20 bp, Artificial Sequence
  Description of Artificial Sequence: Synthetic oligonucleotide
  Target: AGXT; (+) strand; PAM type: YTN; PAM sequence: TTT
tctttctttcatgtttttct

SEQ ID NO: 16455 - DNA, 20 bp, Artificial Sequence
  Description of Artificial Sequence: Synthetic oligonucleotide
  Target: AGXT; (+) strand; PAM type: YTN; PAM sequence: TTT
ctttctttcatgtttttctc

SEQ ID NO: 16456 - DNA, 20 bp, Artificial Sequence
  Description of Artificial Sequence: Synthetic oligonucleotide
  Target: AGXT; (+) strand; PAM type: YTN; PAM sequence: TTC
tttctttcatgtttttctct

SEQ ID NO: 16457 - DNA, 20 bp, Artificial Sequence
  Description of Artificial Sequence: Synthetic oligonucleotide
  Target: AGXT; (+) strand; PAM type: YTN; PAM sequence: CTT
tctttcatgtttttctcttt

SEQ ID NO: 16458 - DNA, 20 bp, Artificial Sequence
  Description of Artificial Sequence: Synthetic oligonucleotide
  Target: AGXT; (+) strand; PAM type: YTN; PAM sequence: TTT
ctttcatgtttttctcttta

SEQ ID NO: 16459 - DNA, 20 bp, Artificial Sequence
  Description of Artificial Sequence: Synthetic oligonucleotide
  Target: AGXT; (+) strand; PAM type: YTN; PAM sequence: TTC
tttcatgtttttctctttat

SEQ ID NO: 16460 - DNA, 20 bp, Artificial Sequence
  Description of Artificial Sequence: Synthetic oligonucleotide
  Target: AGXT; (+) strand; PAM type: YTN; PAM sequence: CTT
tcatgtttttctctttatct

SEQ ID NO: 16461 - DNA, 20 bp, Artificial Sequence
  Description of Artificial Sequence: Synthetic oligonucleotide
  Target: AGXT; (+) strand; PAM type: YTN; PAM sequence: TTT
catgtttttctctttatctc

SEQ ID NO: 16462 - DNA, 20 bp, Artificial Sequence
  Description of Artificial Sequence: Synthetic oligonucleotide
  Target: AGXT; (+) strand; PAM type: YTN; PAM sequence: TTC
atgtttttctctttatctct

SEQ ID NO: 16463 - DNA, 20 bp, Artificial Sequence
  Description of Artificial Sequence: Synthetic oligonucleotide
  Target: AGXT; (+) strand; PAM type: YTN; PAM sequence: TTT
ttctctttatctctcatata

SEQ ID NO: 16464 - DNA, 20 bp, Artificial Sequence
  Description of Artificial Sequence: Synthetic oligonucleotide
  Target: AGXT; (+) strand; PAM type: YTN; PAM sequence: TTT
tctctttatctctcatataa

SEQ ID NO: 16465 - DNA, 20 bp, Artificial Sequence
  Description of Artificial Sequence: Synthetic oligonucleotide
  Target: AGXT; (+) strand; PAM type: YTN; PAM sequence: TTT
ctctttatctctcatataaa

SEQ ID NO: 16466 - DNA, 20 bp, Artificial Sequence
  Description of Artificial Sequence: Synthetic oligonucleotide
  Target: AGXT; (+) strand; PAM type: YTN; PAM sequence: TTC
tctttatctctcatataaaa

SEQ ID NO: 16467 - DNA, 20 bp, Artificial Sequence
  Description of Artificial Sequence: Synthetic oligonucleotide
  Target: AGXT; (+) strand; PAM type: YTN; PAM sequence: CTC
tttatctctcatataaaaac

SEQ ID NO: 16468 - DNA, 20 bp, Artificial Sequence
  Description of Artificial Sequence: Synthetic oligonucleotide
  Target: AGXT; (+) strand; PAM type: YTN; PAM sequence: CTT
tatctctcatataaaaactt

SEQ ID NO: 16469 - DNA, 20 bp, Artificial Sequence
  Description of Artificial Sequence: Synthetic oligonucleotide
  Target: AGXT; (+) strand; PAM type: YTN; PAM sequence: TTT
atctctcatataaaaacttc

SEQ ID NO: 16470 - DNA, 20 bp, Artificial Sequence
  Description of Artificial Sequence: Synthetic oligonucleotide
  Target: AGXT; (+) strand; PAM type: YTN; PAM sequence: TTA
tctctcatataaaaacttcc

SEQ ID NO: 16471 - DNA, 20 bp, Artificial Sequence
  Description of Artificial Sequence: Synthetic oligonucleotide
  Target: AGXT; (+) strand; PAM type: YTN; PAM sequence: CTC
tcatataaaaacttcccaat

SEQ ID NO: 16472 - DNA, 20 bp, Artificial Sequence
  Description of Artificial Sequence: Synthetic oligonucleotide
  Target: AGXT; (+) strand; PAM type: YTN; PAM sequence: CTC
atataaaaacttcccaatcc

SEQ ID NO: 16473 - DNA, 20 bp, Artificial Sequence
  Description of Artificial Sequence: Synthetic oligonucleotide
  Target: AGXT; (+) strand; PAM type: YTN; PAM sequence: CTT
cccaatcctcttggtttgac

SEQ ID NO: 16474 - DNA, 20 bp, Artificial Sequence
  Description of Artificial Sequence: Synthetic oligonucleotide
  Target: AGXT; (+) strand; PAM type: YTN; PAM sequence: TTC
ccaatcctcttggtttgaca

SEQ ID NO: 16475 - DNA, 20 bp, Artificial Sequence
  Description of Artificial Sequence: Synthetic oligonucleotide
  Target: AGXT; (+) strand; PAM type: YTN; PAM sequence: CTC
ttggtttgacaatatcatct

SEQ ID NO: 16476 - DNA, 20 bp, Artificial Sequence
  Description of Artificial Sequence: Synthetic oligonucleotide
  Target: AGXT; (+) strand; PAM type: YTN; PAM sequence: CTT
ggtttgacaatatcatcttc

SEQ ID NO: 16477 - DNA, 20 bp, Artificial Sequence
  Description of Artificial Sequence: Synthetic oligonucleotide
  Target: AGXT; (+) strand; PAM type: YTN; PAM sequence: TTG
gtttgacaatatcatcttca

SEQ ID NO: 16478 - DNA, 20 bp, Artificial Sequence
  Description of Artificial Sequence: Synthetic oligonucleotide
  Target: AGXT; (+) strand; PAM type: YTN; PAM sequence: TTT
gacaatatcatcttcagcat

SEQ ID NO: 16479 - DNA, 20 bp, Artificial Sequence
  Description of Artificial Sequence: Synthetic oligonucleotide
  Target: AGXT; (+) strand; PAM type: YTN; PAM sequence: TTG
acaatatcatcttcagcatc

SEQ ID NO: 16480 - DNA, 20 bp, Artificial Sequence
  Description of Artificial Sequence: Synthetic oligonucleotide
  Target: AGXT; (+) strand; PAM type: YTN; PAM sequence: CTT
cagcatctcacatgctattg

SEQ ID NO: 16481 - DNA, 20 bp, Artificial Sequence
  Description of Artificial Sequence: Synthetic oligonucleotide
  Target: AGXT; (+) strand; PAM type: YTN; PAM sequence: TTC
agcatctcacatgctattgt

SEQ ID NO: 16482 - DNA, 20 bp, Artificial Sequence
  Description of Artificial Sequence: Synthetic oligonucleotide
  Target: AGXT; (+) strand; PAM type: YTN; PAM sequence: CTC
acatgctattgtgagaggag

SEQ ID NO: 16483 - DNA, 20 bp, Artificial Sequence
  Description of Artificial Sequence: Synthetic oligonucleotide
  Target: AGXT; (+) strand; PAM type: YTN; PAM sequence: CTA
ttgtgagaggagaaaatact

SEQ ID NO: 16484 - DNA, 20 bp, Artificial Sequence
  Description of Artificial Sequence: Synthetic oligonucleotide
  Target: AGXT; (+) strand; PAM type: YTN; PAM sequence: TTG
tgagaggagaaaatactctg

SEQ ID NO: 16485 - DNA, 20 bp, Artificial Sequence
  Description of Artificial Sequence: Synthetic oligonucleotide
  Target: AGXT; (+) strand; PAM type: YTN; PAM sequence: CTC
tgtgtggctggctttgccgt

SEQ ID NO: 16486 - DNA, 20 bp, Artificial Sequence
  Description of Artificial Sequence: Synthetic oligonucleotide
  Target: AGXT; (+) strand; PAM type: YTN; PAM sequence: CTG
tgtggctggctttgccgtcc

SEQ ID NO: 16487 - DNA, 20 bp, Artificial Sequence
  Description of Artificial Sequence: Synthetic oligonucleotide
  Target: AGXT; (+) strand; PAM type: YTN; PAM sequence: CTG
gctttgccgtccacaacctg

SEQ ID NO: 16488 - DNA, 20 bp, Artificial Sequence
  Description of Artificial Sequence: Synthetic oligonucleotide
  Target: AGXT; (+) strand; PAM type: YTN; PAM sequence: CTT
tgccgtccacaacctgctac

SEQ ID NO: 16489 - DNA, 20 bp, Artificial Sequence
  Description of Artificial Sequence: Synthetic oligonucleotide
  Target: AGXT; (+) strand; PAM type: YTN; PAM sequence: TTT
gccgtccacaacctgctact

SEQ ID NO: 16490 - DNA, 20 bp, Artificial Sequence
  Description of Artificial Sequence: Synthetic oligonucleotide
  Target: AGXT; (+) strand; PAM type: YTN; PAM sequence: TTG
ccgtccacaacctgctactc

SEQ ID NO: 16491 - DNA, 20 bp, Artificial Sequence
  Description of Artificial Sequence: Synthetic oligonucleotide
  Target: AGXT; (+) strand; PAM type: YTN; PAM sequence: CTG
ctactccaagccatgtagat

SEQ ID NO: 16492 - DNA, 20 bp, Artificial Sequence
  Description of Artificial Sequence: Synthetic oligonucleotide
  Target: AGXT; (+) strand; PAM type: YTN; PAM sequence: CTA
ctccaagccatgtagattct

SEQ ID NO: 16493 - DNA, 20 bp, Artificial Sequence
  Description of Artificial Sequence: Synthetic oligonucleotide
  Target: AGXT; (+) strand; PAM type: YTN; PAM sequence: CTC
caagccatgtagattcttct

SEQ ID NO: 16494 - DNA, 20 bp, Artificial Sequence
  Description of Artificial Sequence: Synthetic oligonucleotide
  Target: AGXT; (+) strand; PAM type: YTN; PAM sequence: TTC
ttcttcgtaagcacaccctg

SEQ ID NO: 16495 - DNA, 20 bp, Artificial Sequence
  Description of Artificial Sequence: Synthetic oligonucleotide
  Target: AGXT; (+) strand; PAM type: YTN; PAM sequence: CTT
cttcgtaagcacaccctgtc

SEQ ID NO: 16496 - DNA, 20 bp, Artificial Sequence
  Description of Artificial Sequence: Synthetic oligonucleotide
  Target: AGXT; (+) strand; PAM type: YTN; PAM sequence: TTC
ttcgtaagcacaccctgtct

SEQ ID NO: 16497 - DNA, 20 bp, Artificial Sequence
  Description of Artificial Sequence: Synthetic oligonucleotide
  Target: AGXT; (+) strand; PAM type: YTN; PAM sequence: CTT
cgtaagcacaccctgtctcc

SEQ ID NO: 16498 - DNA, 20 bp, Artificial Sequence
  Description of Artificial Sequence: Synthetic oligonucleotide
  Target: AGXT; (+) strand; PAM type: YTN; PAM sequence: TTC
gtaagcacaccctgtctcca

SEQ ID NO: 16499 - DNA, 20 bp, Artificial Sequence
  Description of Artificial Sequence: Synthetic oligonucleotide
  Target: AGXT; (+) strand; PAM type: YTN; PAM sequence: CTG
tctccaatcaaactgtactg

SEQ ID NO: 16500 - DNA, 20 bp, Artificial Sequence
  Description of Artificial Sequence: Synthetic oligonucleotide
  Target: AGXT; (+) strand; PAM type: YTN; PAM sequence: CTC
caatcaaactgtactgttgg

SEQ ID NO: 16501 - DNA, 20 bp, Artificial Sequence
  Description of Artificial Sequence: Synthetic oligonucleotide
  Target: AGXT; (+) strand; PAM type: YTN; PAM sequence: CTG
tactgttgggatttcattat

SEQ ID NO: 16502 - DNA, 20 bp, Artificial Sequence
  Description of Artificial Sequence: Synthetic oligonucleotide
  Target: AGXT; (+) strand; PAM type: YTN; PAM sequence: CTG
ttgggatttcattattcttc

SEQ ID NO: 16503 - DNA, 20 bp, Artificial Sequence
  Description of Artificial Sequence: Synthetic oligonucleotide
  Target: AGXT; (+) strand; PAM type: YTN; PAM sequence: TTG
ggatttcattattcttctca

SEQ ID NO: 16504 - DNA, 20 bp, Artificial Sequence
  Description of Artificial Sequence: Synthetic oligonucleotide
  Target: AGXT; (+) strand; PAM type: YTN; PAM sequence: TTT
cattattcttctcaccactc

SEQ ID NO: 16505 - DNA, 20 bp, Artificial Sequence
  Description of Artificial Sequence: Synthetic oligonucleotide
  Target: AGXT; (+) strand; PAM type: YTN; PAM sequence: TTC
attattcttctcaccactcc

SEQ ID NO: 16506 - DNA, 20 bp, Artificial Sequence
  Description of Artificial Sequence: Synthetic oligonucleotide
  Target: AGXT; (+) strand; PAM type: YTN; PAM sequence: TTA
ttcttctcaccactccttcc

SEQ ID NO: 16507 - DNA, 20 bp, Artificial Sequence
  Description of Artificial Sequence: Synthetic oligonucleotide
  Target: AGXT; (+) strand; PAM type: YTN; PAM sequence: TTC
ttctcaccactccttcccac

SEQ ID NO: 16508 - DNA, 20 bp, Artificial Sequence
  Description of Artificial Sequence: Synthetic oligonucleotide
  Target: AGXT; (+) strand; PAM type: YTN; PAM sequence: CTT
ctcaccactccttcccaccc

SEQ ID NO: 16509 - DNA, 20 bp, Artificial Sequence
  Description of Artificial Sequence: Synthetic oligonucleotide
  Target: AGXT; (+) strand; PAM type: YTN; PAM sequence: TTC
tcaccactccttcccacccc

SEQ ID NO: 16510 - DNA, 20 bp, Artificial Sequence
  Description of Artificial Sequence: Synthetic oligonucleotide
  Target: AGXT; (+) strand; PAM type: YTN; PAM sequence: CTC
accactccttcccaccccga

SEQ ID NO: 16511 - DNA, 20 bp, Artificial Sequence
  Description of Artificial Sequence: Synthetic oligonucleotide
  Target: AGXT; (+) strand; PAM type: YTN; PAM sequence: CTC
cttcccaccccgaccatttc

SEQ ID NO: 16512 - DNA, 20 bp, Artificial Sequence
  Description of Artificial Sequence: Synthetic oligonucleotide
  Target: AGXT; (+) strand; PAM type: YTN; PAM sequence: CTT
cccaccccgaccatttcctt

SEQ ID NO: 16513 - DNA, 20 bp, Artificial Sequence
  Description of Artificial Sequence: Synthetic oligonucleotide
  Target: AGXT; (+) strand; PAM type: YTN; PAM sequence: TTC
ccaccccgaccatttccttc

SEQ ID NO: 16514 - DNA, 20 bp, Artificial Sequence
  Description of Artificial Sequence: Synthetic oligonucleotide
  Target: AGXT; (+) strand; PAM type: YTN; PAM sequence: TTT
ccttctgtgctggtaaattg

SEQ ID NO: 16515 - DNA, 20 bp, Artificial Sequence
  Description of Artificial Sequence: Synthetic oligonucleotide
  Target: AGXT; (+) strand; PAM type: YTN; PAM sequence: TTC
cttctgtgctggtaaattgg

SEQ ID NO: 16516 - DNA, 20 bp, Artificial Sequence
  Description of Artificial Sequence: Synthetic oligonucleotide
  Target: AGXT; (+) strand; PAM type: YTN; PAM sequence: CTT
ctgtgctggtaaattggaaa

SEQ ID NO: 16517 - DNA, 20 bp, Artificial Sequence
  Description of Artificial Sequence: Synthetic oligonucleotide
  Target: AGXT; (+) strand; PAM type: YTN; PAM sequence: TTC
tgtgctggtaaattggaaac

SEQ ID NO: 16518 - DNA, 20 bp, Artificial Sequence
  Description of Artificial Sequence: Synthetic oligonucleotide
  Target: AGXT; (+) strand; PAM type: YTN; PAM sequence: CTG
tgctggtaaattggaaacca

SEQ ID NO: 16519 - DNA, 20 bp, Artificial Sequence
  Description of Artificial Sequence: Synthetic oligonucleotide
  Target: AGXT; (+) strand; PAM type: YTN; PAM sequence: CTG
gtaaattggaaaccacctcc

SEQ ID NO: 16520 - DNA, 20 bp, Artificial Sequence
  Description of Artificial Sequence: Synthetic oligonucleotide
  Target: AGXT; (+) strand; PAM type: YTN; PAM sequence: TTG
gaaaccacctccctcttcgt

SEQ ID NO: 16521 - DNA, 20 bp, Artificial Sequence
  Description of Artificial Sequence: Synthetic oligonucleotide
  Target: AGXT; (+) strand; PAM type: YTN; PAM sequence: CTC
cctcttcgtgctatcatatt

SEQ ID NO: 16522 - DNA, 20 bp, Artificial Sequence
  Description of Artificial Sequence: Synthetic oligonucleotide
  Target: AGXT; (+) strand; PAM type: YTN; PAM sequence: CTC
ttcgtgctatcatattactt

SEQ ID NO: 16523 - DNA, 20 bp, Artificial Sequence
  Description of Artificial Sequence: Synthetic oligonucleotide
  Target: AGXT; (+) strand; PAM type: YTN; PAM sequence: CTT
cgtgctatcatattacttcc

SEQ ID NO: 16524 - DNA, 20 bp, Artificial Sequence
  Description of Artificial Sequence: Synthetic oligonucleotide
  Target: AGXT; (+) strand; PAM type: YTN; PAM sequence: TTC
gtgctatcatattacttccc

SEQ ID NO: 16525 - DNA, 20 bp, Artificial Sequence
  Description of Artificial Sequence: Synthetic oligonucleotide
  Target: AGXT; (+) strand; PAM type: YTN; PAM sequence: CTA
tcatattacttcccccacca

SEQ ID NO: 16526 - DNA, 20 bp, Artificial Sequence
  Description of Artificial Sequence: Synthetic oligonucleotide
  Target: AGXT; (+) strand; PAM type: YTN; PAM sequence: TTA
cttcccccaccatccacact

SEQ ID NO: 16527 - DNA, 20 bp, Artificial Sequence
  Description of Artificial Sequence: Synthetic oligonucleotide
  Target: AGXT; (+) strand; PAM type: YTN; PAM sequence: CTT
cccccaccatccacacttac

SEQ ID NO: 16528 - DNA, 20 bp, Artificial Sequence
  Description of Artificial Sequence: Synthetic oligonucleotide
  Target: AGXT; (+) strand; PAM type: YTN; PAM sequence: TTC
ccccaccatccacacttaca

SEQ ID NO: 16529 - DNA, 20 bp, Artificial Sequence
  Description of Artificial Sequence: Synthetic oligonucleotide
  Target: AGXT; (+) strand; PAM type: YTN; PAM sequence: CTT
acaatatcactgaaacttcc

SEQ ID NO: 16530 - DNA, 20 bp, Artificial Sequence
  Description of Artificial Sequence: Synthetic oligonucleotide
  Target: AGXT; (+) strand; PAM type: YTN; PAM sequence: TTA
caatatcactgaaacttcct

SEQ ID NO: 16531 - DNA, 20 bp, Artificial Sequence
  Description of Artificial Sequence: Synthetic oligonucleotide
  Target: AGXT; (+) strand; PAM type: YTN; PAM sequence: CTG
aaacttccttaacttgtaat

SEQ ID NO: 16532 - DNA, 20 bp, Artificial Sequence
  Description of Artificial Sequence: Synthetic oligonucleotide
  Target: AGXT; (+) strand; PAM type: YTN; PAM sequence: CTT
ccttaacttgtaatgttatt

SEQ ID NO: 16533 - DNA, 20 bp, Artificial Sequence
  Description of Artificial Sequence: Synthetic oligonucleotide
  Target: AGXT; (+) strand; PAM type: YTN; PAM sequence: TTC
cttaacttgtaatgttattt

SEQ ID NO: 16534 - DNA, 20 bp, Artificial Sequence
  Description of Artificial Sequence: Synthetic oligonucleotide
  Target: AGXT; (+) strand; PAM type: YTN; PAM sequence: CTT
aacttgtaatgttattttgg

SEQ ID NO: 16535 - DNA, 20 bp, Artificial Sequence
  Description of Artificial Sequence: Synthetic oligonucleotide
  Target: AGXT; (+) strand; PAM type: YTN; PAM sequence: TTA
acttgtaatgttattttggg

SEQ ID NO: 16536 - DNA, 20 bp, Artificial Sequence
  Description of Artificial Sequence: Synthetic oligonucleotide
  Target: AGXT; (+) strand; PAM type: YTN; PAM sequence: CTT
gtaatgttattttgggaggt

SEQ ID NO: 16537 - DNA, 20 bp, Artificial Sequence
  Description of Artificial Sequence: Synthetic oligonucleotide
  Target: AGXT; (+) strand; PAM type: YTN; PAM sequence: TTG
taatgttattttgggaggta

SEQ ID NO: 16538 - DNA, 20 bp, Artificial Sequence
  Description of Artificial Sequence: Synthetic oligonucleotide
  Target: AGXT; (+) strand; PAM type: YTN; PAM sequence: TTA
ttttgggaggtacaccttgt

SEQ ID NO: 16539 - DNA, 20 bp, Artificial Sequence
  Description of Artificial Sequence: Synthetic oligonucleotide
  Target: AGXT; (+) strand; PAM type: YTN; PAM sequence: TTT
tgggaggtacaccttgttat

SEQ ID NO: 16540 - DNA, 20 bp, Artificial Sequence
  Description of Artificial Sequence: Synthetic oligonucleotide
  Target: AGXT; (+) strand; PAM type: YTN; PAM sequence: TTT
gggaggtacaccttgttata

SEQ ID NO: 16541 - DNA, 20 bp, Artificial Sequence
  Description of Artificial Sequence: Synthetic oligonucleotide
  Target: AGXT; (+) strand; PAM type: YTN; PAM sequence: TTG
ggaggtacaccttgttataa

SEQ ID NO: 16542 - DNA, 20 bp, Artificial Sequence
  Description of Artificial Sequence: Synthetic oligonucleotide
  Target: AGXT; (+) strand; PAM type: YTN; PAM sequence: CTT
gttataatgacactcatgca

SEQ ID NO: 16543 - DNA, 20 bp, Artificial Sequence
  Description of Artificial Sequence: Synthetic oligonucleotide
  Target: AGXT; (+) strand; PAM type: YTN; PAM sequence: TTG
ttataatgacactcatgcag

SEQ ID NO: 16544 - DNA, 20 bp, Artificial Sequence
  Description of Artificial Sequence: Synthetic oligonucleotide
  Target: AGXT; (+) strand; PAM type: YTN; PAM sequence: TTA
taatgacactcatgcagcta

SEQ ID NO: 16545 - DNA, 20 bp, Artificial Sequence
  Description of Artificial Sequence: Synthetic oligonucleotide
  Target: AGXT; (+) strand; PAM type: YTN; PAM sequence: CTC
atgcagctaactttgactca

SEQ ID NO: 16546 - DNA, 20 bp, Artificial Sequence
  Description of Artificial Sequence: Synthetic oligonucleotide
  Target: AGXT; (+) strand; PAM type: YTN; PAM sequence: CTA
actttgactcatttgaggcc

SEQ ID NO: 16547 - DNA, 20 bp, Artificial Sequence
  Description of Artificial Sequence: Synthetic oligonucleotide
  Target: AGXT; (+) strand; PAM type: YTN; PAM sequence: CTT
tgactcatttgaggccttcg

SEQ ID NO: 16548 - DNA, 20 bp, Artificial Sequence
  Description of Artificial Sequence: Synthetic oligonucleotide
  Target: AGXT; (+) strand; PAM type: YTN; PAM sequence: TTT
gactcatttgaggccttcgc

SEQ ID NO: 16549 - DNA, 20 bp, Artificial Sequence
  Description of Artificial Sequence: Synthetic oligonucleotide
  Target: AGXT; (+) strand; PAM type: YTN; PAM sequence: TTG
actcatttgaggccttcgcc

SEQ ID NO: 16550 - DNA, 20 bp, Artificial Sequence
  Description of Artificial Sequence: Synthetic oligonucleotide
  Target: AGXT; (+) strand; PAM type: YTN; PAM sequence: CTC
atttgaggccttcgcctcct

SEQ ID NO: 16551 - DNA, 20 bp, Artificial Sequence
  Description of Artificial Sequence: Synthetic oligonucleotide
  Target: AGXT; (+) strand; PAM type: YTN; PAM sequence: TTT
gaggccttcgcctcctacaa

SEQ ID NO: 16552 - DNA, 20 bp, Artificial Sequence
  Description of Artificial Sequence: Synthetic oligonucleotide
  Target: AGXT; (+) strand; PAM type: YTN; PAM sequence: TTG
aggccttcgcctcctacaat

SEQ ID NO: 16553 - DNA, 20 bp, Artificial Sequence
  Description of Artificial Sequence: Synthetic oligonucleotide
  Target: AGXT; (+) strand; PAM type: YTN; PAM sequence: CTT
cgcctcctacaatcaaaact

SEQ ID NO: 16554 - DNA, 20 bp, Artificial Sequence
  Description of Artificial Sequence: Synthetic oligonucleotide
  Target: AGXT; (+) strand; PAM type: YTN; PAM sequence: TTC
gcctcctacaatcaaaactc

SEQ ID NO: 16555 - DNA, 20 bp, Artificial Sequence
  Description of Artificial Sequence: Synthetic oligonucleotide
  Target: AGXT; (+) strand; PAM type: YTN; PAM sequence: CTC
ctacaatcaaaactctgact

SEQ ID NO: 16556 - DNA, 20 bp, Artificial Sequence
  Description of Artificial Sequence: Synthetic oligonucleotide
  Target: AGXT; (+) strand; PAM type: YTN; PAM sequence: CTA
caatcaaaactctgactctg

SEQ ID NO: 16557 - DNA, 20 bp, Artificial Sequence
  Description of Artificial Sequence: Synthetic oligonucleotide
  Target: AGXT; (+) strand; PAM type: YTN; PAM sequence: CTC
tgactctggccaggtgcgct

SEQ ID NO: 16558 - DNA, 20 bp, Artificial Sequence
  Description of Artificial Sequence: Synthetic oligonucleotide
  Target: AGXT; (+) strand; PAM type: YTN; PAM sequence: CTG
actctggccaggtgcgctgg

SEQ ID NO: 16559 - DNA, 20 bp, Artificial Sequence
  Description of Artificial Sequence: Synthetic oligonucleotide
  Target: AGXT; (+) strand; PAM type: YTN; PAM sequence: CTC
tggccaggtgcgctggctca

SEQ ID NO: 16560 - DNA, 20 bp, Artificial Sequence
  Description of Artificial Sequence: Synthetic oligonucleotide
  Target: AGXT; (+) strand; PAM type: YTN; PAM sequence: CTG
gccaggtgcgctggctcaca

SEQ ID NO: 16561 - DNA, 20 bp, Artificial Sequence
  Description of Artificial Sequence: Synthetic oligonucleotide
  Target: AGXT; (+) strand; PAM type: YTN; PAM sequence: CTG
gctcacacctgtaatcctaa

SEQ ID NO: 16562 - DNA, 20 bp, Artificial Sequence
  Description of Artificial Sequence: Synthetic oligonucleotide
  Target: AGXT; (+) strand; PAM type: YTN; PAM sequence: CTC
acacctgtaatcctaacact

SEQ ID NO: 16563 - DNA, 20 bp, Artificial Sequence
  Description of Artificial Sequence: Synthetic oligonucleotide
  Target: AGXT; (+) strand; PAM type: YTN; PAM sequence: CTG
taatcctaacactttgggag

SEQ ID NO: 16564 - DNA, 20 bp, Artificial Sequence
  Description of Artificial Sequence: Synthetic oligonucleotide
  Target: AGXT; (+) strand; PAM type: YTN; PAM sequence: CTA
acactttgggaggtagaggt

SEQ ID NO: 16565 - DNA, 20 bp, Artificial Sequence
  Description of Artificial Sequence: Synthetic oligonucleotide
  Target: AGXT; (+) strand; PAM type: YTN; PAM sequence: CTT
tgggaggtagaggtgggtgg

SEQ ID NO: 16566 - DNA, 20 bp, Artificial Sequence
  Description of Artificial Sequence: Synthetic oligonucleotide
  Target: AGXT; (+) strand; PAM type: YTN; PAM sequence: TTT
gggaggtagaggtgggtgga

SEQ ID NO: 16567 - DNA, 20 bp, Artificial Sequence
  Description of Artificial Sequence: Synthetic oligonucleotide
  Target: AGXT; (+) strand; PAM type: YTN; PAM sequence: TTG
ggaggtagaggtgggtggat

SEQ ID NO: 16568 - DNA, 20 bp, Artificial Sequence
  Description of Artificial Sequence: Synthetic oligonucleotide
  Target: AGXT; (+) strand; PAM type: YTN; PAM sequence: CTG
aggtcaggagttcgagacca

SEQ ID NO: 16569 - DNA, 20 bp, Artificial Sequence
  Description of Artificial Sequence: Synthetic oligonucleotide
  Target: AGXT; (+) strand; PAM type: YTN; PAM sequence: TTC
gagaccagtctgaccaacat

SEQ ID NO: 16570 - DNA, 20 bp, Artificial Sequence
  Description of Artificial Sequence: Synthetic oligonucleotide
  Target: AGXT; (+) strand; PAM type: YTN; PAM sequence: CTG
accaacatggtgaaaccctg

SEQ ID NO: 16571 - DNA, 20 bp, Artificial Sequence
  Description of Artificial Sequence: Synthetic oligonucleotide
  Target: AGXT; (+) strand; PAM type: YTN; PAM sequence: CTG
tctctactaaaaatacaaaa

SEQ ID NO: 16572 - DNA, 20 bp, Artificial Sequence
  Description of Artificial Sequence: Synthetic oligonucleotide
  Target: AGXT; (+) strand; PAM type: YTN; PAM sequence: CTC
tactaaaaatacaaaaatta

SEQ ID NO: 16573 - DNA, 20 bp, Artificial Sequence
  Description of Artificial Sequence: Synthetic oligonucleotide
  Target: AGXT; (+) strand; PAM type: YTN; PAM sequence: CTA
ctaaaaatacaaaaattagc

SEQ ID NO: 16574 - DNA, 20 bp, Artificial Sequence
  Description of Artificial Sequence: Synthetic oligonucleotide
  Target: AGXT; (+) strand; PAM type: YTN; PAM sequence: CTA
aaaatacaaaaattagcagg

SEQ ID NO: 16575 - DNA, 20 bp, Artificial Sequence
  Description of Artificial Sequence: Synthetic oligonucleotide
  Target: AGXT; (+) strand; PAM type: YTN; PAM sequence: TTA
gcagggcgtggtggcaggtg

SEQ ID NO: 16576 - DNA, 20 bp, Artificial Sequence
  Description of Artificial Sequence: Synthetic oligonucleotide
  Target: AGXT; (+) strand; PAM type: YTN; PAM sequence: CTG
taatcccagctactcaggag

SEQ ID NO: 16577 - DNA, 20 bp, Artificial Sequence
  Description of Artificial Sequence: Synthetic oligonucleotide
  Target: AGXT; (+) strand; PAM type: YTN; PAM sequence: CTA
ctcaggaggctgaggcagga

SEQ ID NO: 16578 - DNA, 20 bp, Artificial Sequence
  Description of Artificial Sequence: Synthetic oligonucleotide
  Target: AGXT; (+) strand; PAM type: YTN; PAM sequence: CTC
aggaggctgaggcaggagaa

SEQ ID NO: 16579 - DNA, 20 bp, Artificial Sequence
  Description of Artificial Sequence: Synthetic oligonucleotide
  Target: AGXT; (+) strand; PAM type: YTN; PAM sequence: CTG
aggcaggagaatcgcttgaa

SEQ ID NO: 16580 - DNA, 20 bp, Artificial Sequence
  Description of Artificial Sequence: Synthetic oligonucleotide
  Target: AGXT; (+) strand; PAM type: YTN; PAM sequence: CTT
gaacccaggagcagaggttg

SEQ ID NO: 16581 - DNA, 20 bp, Artificial Sequence
  Description of Artificial Sequence: Synthetic oligonucleotide
  Target: AGXT; (+) strand; PAM type: YTN; PAM sequence: TTG
aacccaggagcagaggttgc

SEQ ID NO: 16582 - DNA, 20 bp, Artificial Sequence
  Description of Artificial Sequence: Synthetic oligonucleotide
  Target: AGXT; (+) strand; PAM type: YTN; PAM sequence: TTG
cagtgagccaaggtcacacc

SEQ ID NO: 16583 - DNA, 20 bp, Artificial Sequence
  Description of Artificial Sequence: Synthetic oligonucleotide
  Target: AGXT; (+) strand; PAM type: YTN; PAM sequence: CTT
cactccagcctgggcaactg

SEQ ID NO: 16584 - DNA, 20 bp, Artificial Sequence
  Description of Artificial Sequence: Synthetic oligonucleotide
  Target: AGXT; (+) strand; PAM type: YTN; PAM sequence: TTC
actccagcctgggcaactga

SEQ ID NO: 16585 - DNA, 20 bp, Artificial Sequence
  Description of Artificial Sequence: Synthetic oligonucleotide
  Target: AGXT; (+) strand; PAM type: YTN; PAM sequence: CTC
cagcctgggcaactgagtga

SEQ ID NO: 16586 - DNA, 20 bp, Artificial Sequence
  Description of Artificial Sequence: Synthetic oligonucleotide
  Target: AGXT; (+) strand; PAM type: YTN; PAM sequence: CTG
ggcaactgagtgagactcca

SEQ ID NO: 16587 - DNA, 20 bp, Artificial Sequence
  Description of Artificial Sequence: Synthetic oligonucleotide
  Target: AGXT; (+) strand; PAM type: YTN; PAM sequence: CTG
agtgagactccatctcaaaa

SEQ ID NO: 16588 - DNA, 20 bp, Artificial Sequence
  Description of Artificial Sequence: Synthetic oligonucleotide
  Target: AGXT; (+) strand; PAM type: YTN; PAM sequence: CTC
catctcaaaaaaaaaaaaaa

SEQ ID NO: 16589 - DNA, 20 bp, Artificial Sequence
  Description of Artificial Sequence: Synthetic oligonucleotide
  Target: AGXT; (+) strand; PAM type: YTN; PAM sequence: CTC
aaaaaaaaaaaaaaaaaaaa

SEQ ID NO: 16590 - DNA, 20 bp, Artificial Sequence
  Description of Artificial Sequence: Synthetic oligonucleotide
  Target: AGXT; (+) strand; PAM type: YTN; PAM sequence: CTG
actctatctcatcactgcca

SEQ ID NO: 16591 - DNA, 20 bp, Artificial Sequence
  Description of Artificial Sequence: Synthetic oligonucleotide
  Target: AGXT; (+) strand; PAM type: YTN; PAM sequence: CTC
tatctcatcactgccaattt

SEQ ID NO: 16592 - DNA, 20 bp, Artificial Sequence
  Description of Artificial Sequence: Synthetic oligonucleotide
  Target: AGXT; (+) strand; PAM type: YTN; PAM sequence: CTA
tctcatcactgccaatttat

SEQ ID NO: 16593 - DNA, 20 bp, Artificial Sequence
  Description of Artificial Sequence: Synthetic oligonucleotide
  Target: AGXT; (+) strand; PAM type: YTN; PAM sequence: CTC
atcactgccaatttataagc

SEQ ID NO: 16594 - DNA, 20 bp, Artificial Sequence
  Description of Artificial Sequence: Synthetic oligonucleotide
  Target: AGXT; (+) strand; PAM type: YTN; PAM sequence: CTG
ccaatttataagccgttaaa

SEQ ID NO: 16595 - DNA, 20 bp, Artificial Sequence
  Description of Artificial Sequence: Synthetic oligonucleotide
  Target: AGXT; (+) strand; PAM type: YTN; PAM sequence: TTT
ataagccgttaaactggacc

SEQ ID NO: 16596 - DNA, 20 bp, Artificial Sequence
  Description of Artificial Sequence: Synthetic oligonucleotide
  Target: AGXT; (+) strand; PAM type: YTN; PAM sequence: TTA
taagccgttaaactggacca

SEQ ID NO: 16597 - DNA, 20 bp, Artificial Sequence
  Description of Artificial Sequence: Synthetic oligonucleotide
  Target: AGXT; (+) strand; PAM type: YTN; PAM sequence: TTA
aactggaccagtatagtggg

SEQ ID NO: 16598 - DNA, 20 bp, Artificial Sequence
  Description of Artificial Sequence: Synthetic oligonucleotide
  Target: AGXT; (+) strand; PAM type: YTN; PAM sequence: CTG
gaccagtatagtggggctcc

SEQ ID NO: 16599 - DNA, 20 bp, Artificial Sequence
  Description of Artificial Sequence: Synthetic oligonucleotide
  Target: AGXT; (+) strand; PAM type: YTN; PAM sequence: CTC
ccagtatacagcacccctgc

SEQ ID NO: 16600 - DNA, 20 bp, Artificial Sequence
  Description of Artificial Sequence: Synthetic oligonucleotide
  Target: AGXT; (+) strand; PAM type: YTN; PAM sequence: CTG
cactcctaataccttcatgt

SEQ ID NO: 16601 - DNA, 20 bp, Artificial Sequence
  Description of Artificial Sequence: Synthetic oligonucleotide
  Target: AGXT; (+) strand; PAM type: YTN; PAM sequence: CTC
ctaataccttcatgtatgtt

SEQ ID NO: 16602 - DNA, 20 bp, Artificial Sequence
  Description of Artificial Sequence: Synthetic oligonucleotide
  Target: AGXT; (+) strand; PAM type: YTN; PAM sequence: CTA
ataccttcatgtatgttact

SEQ ID NO: 16603 - DNA, 20 bp, Artificial Sequence
  Description of Artificial Sequence: Synthetic oligonucleotide
  Target: AGXT; (+) strand; PAM type: YTN; PAM sequence: CTT
catgtatgttactataatga

SEQ ID NO: 16604 - DNA, 20 bp, Artificial Sequence
  Description of Artificial Sequence: Synthetic oligonucleotide
  Target: AGXT; (+) strand; PAM type: YTN; PAM sequence: TTC
atgtatgttactataatgat

SEQ ID NO: 16605 - DNA, 20 bp, Artificial Sequence
  Description of Artificial Sequence: Synthetic oligonucleotide
  Target: AGXT; (+) strand; PAM type: YTN; PAM sequence: TTA
ctataatgatgcaaccagtg

SEQ ID NO: 16606 - DNA, 20 bp, Artificial Sequence
  Description of Artificial Sequence: Synthetic oligonucleotide
  Target: AGXT; (+) strand; PAM type: YTN; PAM sequence: CTA
taatgatgcaaccagtgcag

SEQ ID NO: 16607 - DNA, 20 bp, Artificial Sequence
  Description of Artificial Sequence: Synthetic oligonucleotide
  Target: AGXT; (+) strand; PAM type: YTN; PAM sequence: CTG
gtttacatcctatgccatgc

SEQ ID NO: 16608 - DNA, 20 bp, Artificial Sequence
  Description of Artificial Sequence: Synthetic oligonucleotide
  Target: AGXT; (+) strand; PAM type: YTN; PAM sequence: TTT
acatcctatgccatgcactg

SEQ ID NO: 16609 - DNA, 20 bp, Artificial Sequence
  Description of Artificial Sequence: Synthetic oligonucleotide
  Target: AGXT; (+) strand; PAM type: YTN; PAM sequence: TTA
catcctatgccatgcactgg

SEQ ID NO: 16610 - DNA, 20 bp, Artificial Sequence
  Description of Artificial Sequence: Synthetic oligonucleotide
  Target: AGXT; (+) strand; PAM type: YTN; PAM sequence: CTA
tgccatgcactggcacccgc

SEQ ID NO: 16611 - DNA, 20 bp, Artificial Sequence
  Description of Artificial Sequence: Synthetic oligonucleotide
  Target: AGXT; (+) strand; PAM type: YTN; PAM sequence: CTG
gcacccgcctgcttttaaac

SEQ ID NO: 16612 - DNA, 20 bp, Artificial Sequence
  Description of Artificial Sequence: Synthetic oligonucleotide
  Target: AGXT; (+) strand; PAM type: YTN; PAM sequence: CTG
cttttaaacctcctccatca

SEQ ID NO: 16613 - DNA, 20 bp, Artificial Sequence
  Description of Artificial Sequence: Synthetic oligonucleotide
  Target: AGXT; (+) strand; PAM type: YTN; PAM sequence: CTT
ttaaacctcctccatcagta

SEQ ID NO: 16614 - DNA, 20 bp, Artificial Sequence
  Description of Artificial Sequence: Synthetic oligonucleotide
  Target: AGXT; (+) strand; PAM type: YTN; PAM sequence: TTT
taaacctcctccatcagtac

SEQ ID NO: 16615 - DNA, 20 bp, Artificial Sequence
  Description of Artificial Sequence: Synthetic oligonucleotide
  Target: AGXT; (+) strand; PAM type: YTN; PAM sequence: TTT
aaacctcctccatcagtaca

SEQ ID NO: 16616 - DNA, 20 bp, Artificial Sequence
  Description of Artificial Sequence: Synthetic oligonucleotide
  Target: AGXT; (+) strand; PAM type: YTN; PAM sequence: TTA
aacctcctccatcagtacat

SEQ ID NO: 16617 - DNA, 20 bp, Artificial Sequence
  Description of Artificial Sequence: Synthetic oligonucleotide
  Target: AGXT; (+) strand; PAM type: YTN; PAM sequence: CTC
ctccatcagtacataaacat

SEQ ID NO: 16618 - DNA, 20 bp, Artificial Sequence
  Description of Artificial Sequence: Synthetic oligonucleotide
  Target: AGXT; (+) strand; PAM type: YTN; PAM sequence: CTC
catcagtacataaacatagt

SEQ ID NO: 16619 - DNA, 20 bp, Artificial Sequence
  Description of Artificial Sequence: Synthetic oligonucleotide
  Target: AGXT; (+) strand; PAM type: YTN; PAM sequence: CTT
tcccccatatgagtcctctt

SEQ ID NO: 16620 - DNA, 20 bp, Artificial Sequence
  Description of Artificial Sequence: Synthetic oligonucleotide
  Target: AGXT; (+) strand; PAM type: YTN; PAM sequence: TTT
cccccatatgagtcctctta

SEQ ID NO: 16621 - DNA, 20 bp, Artificial Sequence
  Description of Artificial Sequence: Synthetic oligonucleotide
  Target: AGXT; (+) strand; PAM type: YTN; PAM sequence: TTC
ccccatatgagtcctcttaa

SEQ ID NO: 16622 - DNA, 20 bp, Artificial Sequence
  Description of Artificial Sequence: Synthetic oligonucleotide
  Target: AGXT; (+) strand; PAM type: YTN; PAM sequence: CTC
ttaaaactgtcaaaaggccc

SEQ ID NO: 16623 - DNA, 20 bp, Artificial Sequence
  Description of Artificial Sequence: Synthetic oligonucleotide
  Target: AGXT; (+) strand; PAM type: YTN; PAM sequence: CTT
aaaactgtcaaaaggcccat

SEQ ID NO: 16624 - DNA, 20 bp, Artificial Sequence
  Description of Artificial Sequence: Synthetic oligonucleotide
  Target: AGXT; (+) strand; PAM type: YTN; PAM sequence: TTA
aaactgtcaaaaggcccatt

SEQ ID NO: 16625 - DNA, 20 bp, Artificial Sequence
  Description of Artificial Sequence: Synthetic oligonucleotide
  Target: AGXT; (+) strand; PAM type: YTN; PAM sequence: CTG
tcaaaaggcccatttccttt

SEQ ID NO: 16626 - DNA, 20 bp, Artificial Sequence
  Description of Artificial Sequence: Synthetic oligonucleotide
  Target: AGXT; (+) strand; PAM type: YTN; PAM sequence: TTT
ccttttttcccaacatttta

SEQ ID NO: 16627 - DNA, 20 bp, Artificial Sequence
  Description of Artificial Sequence: Synthetic oligonucleotide
  Target: AGXT; (+) strand; PAM type: YTN; PAM sequence: TTC
cttttttcccaacattttaa

SEQ ID NO: 16628 - DNA, 20 bp, Artificial Sequence
  Description of Artificial Sequence: Synthetic oligonucleotide
  Target: AGXT; (+) strand; PAM type: YTN; PAM sequence: CTT
ttttcccaacattttaatta

SEQ ID NO: 16629 - DNA, 20 bp, Artificial Sequence
  Description of Artificial Sequence: Synthetic oligonucleotide
  Target: AGXT; (+) strand; PAM type: YTN; PAM sequence: TTT
tttcccaacattttaattaa

SEQ ID NO: 16630 - DNA, 20 bp, Artificial Sequence
  Description of Artificial Sequence: Synthetic oligonucleotide
  Target: AGXT; (+) strand; PAM type: YTN; PAM sequence: TTT
ttcccaacattttaattaaa

SEQ ID NO: 16631 - DNA, 20 bp, Artificial Sequence
  Description of Artificial Sequence: Synthetic oligonucleotide
  Target: AGXT; (+) strand; PAM type: YTN; PAM sequence: TTT
tcccaacattttaattaaaa

SEQ ID NO: 16632 - DNA, 20 bp, Artificial Sequence
  Description of Artificial Sequence: Synthetic oligonucleotide
  Target: AGXT; (+) strand; PAM type: YTN; PAM sequence: TTT
cccaacattttaattaaaat

SEQ ID NO: 16633 - DNA, 20 bp, Artificial Sequence
  Description of Artificial Sequence: Synthetic oligonucleotide
  Target: AGXT; (+) strand; PAM type: YTN; PAM sequence: TTC
ccaacattttaattaaaata

SEQ ID NO: 16634 - DNA, 20 bp, Artificial Sequence
  Description of Artificial Sequence: Synthetic oligonucleotide
  Target: AGXT; (+) strand; PAM type: YTN; PAM sequence: TTT
taattaaaataatcatcctg

SEQ ID NO: 16635 - DNA, 20 bp, Artificial Sequence
  Description of Artificial Sequence: Synthetic oligonucleotide
  Target: AGXT; (+) strand; PAM type: YTN; PAM sequence: TTT
aattaaaataatcatcctgc

SEQ ID NO: 16636 - DNA, 20 bp, Artificial Sequence
  Description of Artificial Sequence: Synthetic oligonucleotide
  Target: AGXT; (+) strand; PAM type: YTN; PAM sequence: TTA
attaaaataatcatcctgcc

SEQ ID NO: 16637 - DNA, 20 bp, Artificial Sequence
  Description of Artificial Sequence: Synthetic oligonucleotide
  Target: AGXT; (+) strand; PAM type: YTN; PAM sequence: TTA
aaataatcatcctgcccctc

SEQ ID NO: 16638 - DNA, 20 bp, Artificial Sequence
  Description of Artificial Sequence: Synthetic oligonucleotide
  Target: AGXT; (+) strand; PAM type: YTN; PAM sequence: CTG
cccctcctgggctcttatgg

SEQ ID NO: 16639 - DNA, 20 bp, Artificial Sequence
  Description of Artificial Sequence: Synthetic oligonucleotide
  Target: AGXT; (+) strand; PAM type: YTN; PAM sequence: CTC
ctgggctcttatggcttagc

SEQ ID NO: 16640 - DNA, 20 bp, Artificial Sequence
  Description of Artificial Sequence: Synthetic oligonucleotide
  Target: AGXT; (+) strand; PAM type: YTN; PAM sequence: CTG
ggctcttatggcttagcagc

SEQ ID NO: 16641 - DNA, 20 bp, Artificial Sequence
  Description of Artificial Sequence: Synthetic oligonucleotide
  Target: AGXT; (+) strand; PAM type: YTN; PAM sequence: CTC
ttatggcttagcagccccac

SEQ ID NO: 16642 - DNA, 20 bp, Artificial Sequence
  Description of Artificial Sequence: Synthetic oligonucleotide
  Target: AGXT; (+) strand; PAM type: YTN; PAM sequence: CTT
atggcttagcagccccacta

SEQ ID NO: 16643 - DNA, 20 bp, Artificial Sequence
  Description of Artificial Sequence: Synthetic oligonucleotide
  Target: AGXT; (+) strand; PAM type: YTN; PAM sequence: TTA
tggcttagcagccccactaa

SEQ ID NO: 16644 - DNA, 20 bp, Artificial Sequence
  Description of Artificial Sequence: Synthetic oligonucleotide
  Target: AGXT; (+) strand; PAM type: YTN; PAM sequence: CTT
agcagccccactaaaaacta

SEQ ID NO: 16645 - DNA, 20 bp, Artificial Sequence
  Description of Artificial Sequence: Synthetic oligonucleotide
  Target: AGXT; (+) strand; PAM type: YTN; PAM sequence: TTA
gcagccccactaaaaactat

SEQ ID NO: 16646 - DNA, 20 bp, Artificial Sequence
  Description of Artificial Sequence: Synthetic oligonucleotide
  Target: AGXT; (+) strand; PAM type: YTN; PAM sequence: CTA
aaaactatttaaaccctttt

SEQ ID NO: 16647 - DNA, 20 bp, Artificial Sequence
  Description of Artificial Sequence: Synthetic oligonucleotide
  Target: AGXT; (+) strand; PAM type: YTN; PAM sequence: CTA
tttaaacccttttcaagctt

SEQ ID NO: 16648 - DNA, 20 bp, Artificial Sequence
  Description of Artificial Sequence: Synthetic oligonucleotide
  Target: AGXT; (+) strand; PAM type: YTN; PAM sequence: TTT
aaacccttttcaagctttgg

SEQ ID NO: 16649 - DNA, 20 bp, Artificial Sequence
  Description of Artificial Sequence: Synthetic oligonucleotide
  Target: AGXT; (+) strand; PAM type: YTN; PAM sequence: TTA
aacccttttcaagctttggc

SEQ ID NO: 16650 - DNA, 20 bp, Artificial Sequence
  Description of Artificial Sequence: Synthetic oligonucleotide
  Target: AGXT; (+) strand; PAM type: YTN; PAM sequence: CTT
ttcaagctttggccctatcc

SEQ ID NO: 16651 - DNA, 20 bp, Artificial Sequence
  Description of Artificial Sequence: Synthetic oligonucleotide
  Target: AGXT; (+) strand; PAM type: YTN; PAM sequence: TTT
tcaagctttggccctatccc

SEQ ID NO: 16652 - DNA, 20 bp, Artificial Sequence
  Description of Artificial Sequence: Synthetic oligonucleotide
  Target: AGXT; (+) strand; PAM type: YTN; PAM sequence: TTT
caagctttggccctatccca

SEQ ID NO: 16653 - DNA, 20 bp, Artificial Sequence
  Description of Artificial Sequence: Synthetic oligonucleotide
  Target: AGXT; (+) strand; PAM type: YTN; PAM sequence: TTC
aagctttggccctatcccac

SEQ ID NO: 16654 - DNA, 20 bp, Artificial Sequence
  Description of Artificial Sequence: Synthetic oligonucleotide
  Target: AGXT; (+) strand; PAM type: YTN; PAM sequence: CTT
tggccctatcccaccttgat

SEQ ID NO: 16655 - DNA, 20 bp, Artificial Sequence
  Description of Artificial Sequence: Synthetic oligonucleotide
  Target: AGXT; (+) strand; PAM type: YTN; PAM sequence: TTT
ggccctatcccaccttgatc

SEQ ID NO: 16656 - DNA, 20 bp, Artificial Sequence
  Description of Artificial Sequence: Synthetic oligonucleotide
  Target: AGXT; (+) strand; PAM type: YTN; PAM sequence: TTG
gccctatcccaccttgatca

SEQ ID NO: 16657 - DNA, 20 bp, Artificial Sequence
  Description of Artificial Sequence: Synthetic oligonucleotide
  Target: AGXT; (+) strand; PAM type: YTN; PAM sequence: CTA
tcccaccttgatcattctct

SEQ ID NO: 16658 - DNA, 20 bp, Artificial Sequence
  Description of Artificial Sequence: Synthetic oligonucleotide
  Target: AGXT; (+) strand; PAM type: YTN; PAM sequence: CTT
gatcattctcttcactatgg

SEQ ID NO: 16659 - DNA, 20 bp, Artificial Sequence
  Description of Artificial Sequence: Synthetic oligonucleotide
  Target: AGXT; (+) strand; PAM type: YTN; PAM sequence: TTG
atcattctcttcactatggt

SEQ ID NO: 16660 - DNA, 20 bp, Artificial Sequence
  Description of Artificial Sequence: Synthetic oligonucleotide
  Target: AGXT; (+) strand; PAM type: YTN; PAM sequence: TTC
tcttcactatggtgattgta

SEQ ID NO: 16661 - DNA, 20 bp, Artificial Sequence
  Description of Artificial Sequence: Synthetic oligonucleotide
  Target: AGXT; (+) strand; PAM type: YTN; PAM sequence: CTC
ttcactatggtgattgtagc

SEQ ID NO: 16662 - DNA, 20 bp, Artificial Sequence
  Description of Artificial Sequence: Synthetic oligonucleotide
  Target: AGXT; (+) strand; PAM type: YTN; PAM sequence: CTT
cactatggtgattgtagcct

SEQ ID NO: 16663 - DNA, 20 bp, Artificial Sequence
  Description of Artificial Sequence: Synthetic oligonucleotide
  Target: AGXT; (+) strand; PAM type: YTN; PAM sequence: TTC
actatggtgattgtagcctg

SEQ ID NO: 16664 - DNA, 20 bp, Artificial Sequence
  Description of Artificial Sequence: Synthetic oligonucleotide
  Target: AGXT; (+) strand; PAM type: YTN; PAM sequence: CTA
tggtgattgtagcctgggaa

SEQ ID NO: 16665 - DNA, 20 bp, Artificial Sequence
  Description of Artificial Sequence: Synthetic oligonucleotide
  Target: AGXT; (+) strand; PAM type: YTN; PAM sequence: TTG
tagcctgggaacaatagctc

SEQ ID NO: 16666 - DNA, 20 bp, Artificial Sequence
  Description of Artificial Sequence: Synthetic oligonucleotide
  Target: AGXT; (+) strand; PAM type: YTN; PAM sequence: CTG
ggaacaatagctcccaccca

SEQ ID NO: 16667 - DNA, 20 bp, Artificial Sequence
  Description of Artificial Sequence: Synthetic oligonucleotide
  Target: AGXT; (+) strand; PAM type: YTN; PAM sequence: CTC
ccacccaaatcactgtctta

SEQ ID NO: 16668 - DNA, 20 bp, Artificial Sequence
  Description of Artificial Sequence: Synthetic oligonucleotide
  Target: AGXT; (+) strand; PAM type: YTN; PAM sequence: CTG
tcttaaacatcacttctaat

SEQ ID NO: 16669 - DNA, 20 bp, Artificial Sequence
  Description of Artificial Sequence: Synthetic oligonucleotide
  Target: AGXT; (+) strand; PAM type: YTN; PAM sequence: CTT
aaacatcacttctaattcag

SEQ ID NO: 16670 - DNA, 20 bp, Artificial Sequence
  Description of Artificial Sequence: Synthetic oligonucleotide
  Target: AGXT; (+) strand; PAM type: YTN; PAM sequence: TTA
aacatcacttctaattcaga

SEQ ID NO: 16671 - DNA, 20 bp, Artificial Sequence
  Description of Artificial Sequence: Synthetic oligonucleotide
  Target: AGXT; (+) strand; PAM type: YTN; PAM sequence: CTT
ctaattcagaattcccttct

SEQ ID NO: 16672 - DNA, 20 bp, Artificial Sequence
  Description of Artificial Sequence: Synthetic oligonucleotide
  Target: AGXT; (+) strand; PAM type: YTN; PAM sequence: TTC
taattcagaattcccttcta

SEQ ID NO: 16673 - DNA, 20 bp, Artificial Sequence
  Description of Artificial Sequence: Synthetic oligonucleotide
  Target: AGXT; (+) strand; PAM type: YTN; PAM sequence: CTA
attcagaattcccttctaga

SEQ ID NO: 16674 - DNA, 20 bp, Artificial Sequence
  Description of Artificial Sequence: Synthetic oligonucleotide
  Target: AGXT; (+) strand; PAM type: YTN; PAM sequence: TTC
agaattcccttctagaagga

SEQ ID NO: 16675 - DNA, 20 bp, Artificial Sequence
  Description of Artificial Sequence: Synthetic oligonucleotide
  Target: AGXT; (+) strand; PAM type: YTN; PAM sequence: TTC
ccttctagaaggaaaagggc

SEQ ID NO: 16676 - DNA, 20 bp, Artificial Sequence
  Description of Artificial Sequence: Synthetic oligonucleotide
  Target: AGXT; (+) strand; PAM type: YTN; PAM sequence: CTT
ctagaaggaaaagggccctg

SEQ ID NO: 16677 - DNA, 20 bp, Artificial Sequence
  Description of Artificial Sequence: Synthetic oligonucleotide
  Target: AGXT; (+) strand; PAM type: YTN; PAM sequence: TTC
tagaaggaaaagggccctgg

SEQ ID NO: 16678 - DNA, 20 bp, Artificial Sequence
  Description of Artificial Sequence: Synthetic oligonucleotide
  Target: AGXT; (+) strand; PAM type: YTN; PAM sequence: CTA
gaaggaaaagggccctggga

SEQ ID NO: 16679 - DNA, 20 bp, Artificial Sequence
  Description of Artificial Sequence: Synthetic oligonucleotide
  Target: AGXT; (+) strand; PAM type: YTN; PAM sequence: CTG
ggacttactgtggccggagt

SEQ ID NO: 16680 - DNA, 20 bp, Artificial Sequence
  Description of Artificial Sequence: Synthetic oligonucleotide
  Target: AGXT; (+) strand; PAM type: YTN; PAM sequence: CTT
actgtggccggagttgtggg

SEQ ID NO: 16681 - DNA, 20 bp, Artificial Sequence
  Description of Artificial Sequence: Synthetic oligonucleotide
  Target: AGXT; (+) strand; PAM type: YTN; PAM sequence: TTA
ctgtggccggagttgtggga

SEQ ID NO: 16682 - DNA, 20 bp, Artificial Sequence
  Description of Artificial Sequence: Synthetic oligonucleotide
  Target: AGXT; (+) strand; PAM type: YTN; PAM sequence: CTG
tggccggagttgtgggaact

SEQ ID NO: 16683 - DNA, 20 bp, Artificial Sequence
  Description of Artificial Sequence: Synthetic oligonucleotide
  Target: AGXT; (+) strand; PAM type: YTN; PAM sequence: TTG
tgggaactatcacaactctt

SEQ ID NO: 16684 - DNA, 20 bp, Artificial Sequence
  Description of Artificial Sequence: Synthetic oligonucleotide
  Target: AGXT; (+) strand; PAM type: YTN; PAM sequence: CTA
tcacaactcttaccccttgg

SEQ ID NO: 16685 - DNA, 20 bp, Artificial Sequence
  Description of Artificial Sequence: Synthetic oligonucleotide
  Target: AGXT; (+) strand; PAM type: YTN; PAM sequence: CTC
ttaccccttggggaggtttt

SEQ ID NO: 16686 - DNA, 20 bp, Artificial Sequence
  Description of Artificial Sequence: Synthetic oligonucleotide
  Target: AGXT; (+) strand; PAM type: YTN; PAM sequence: CTT
accccttggggaggttttac

SEQ ID NO: 16687 - DNA, 20 bp, Artificial Sequence
  Description of Artificial Sequence: Synthetic oligonucleotide
  Target: AGXT; (+) strand; PAM type: YTN; PAM sequence: TTA
ccccttggggaggttttact

SEQ ID NO: 16688 - DNA, 20 bp, Artificial Sequence
  Description of Artificial Sequence: Synthetic oligonucleotide
  Target: AGXT; (+) strand; PAM type: YTN; PAM sequence: CTT
ggggaggttttacttaccag

SEQ ID NO: 16689 - DNA, 20 bp, Artificial Sequence
  Description of Artificial Sequence: Synthetic oligonucleotide
  Target: AGXT; (+) strand; PAM type: YTN; PAM sequence: TTG
gggaggttttacttaccagg

SEQ ID NO: 16690 - DNA, 20 bp, Artificial Sequence
  Description of Artificial Sequence: Synthetic oligonucleotide
  Target: AGXT; (+) strand; PAM type: YTN; PAM sequence: TTT
tacttaccaggaaatcacaa

SEQ ID NO: 16691 - DNA, 20 bp, Artificial Sequence
  Description of Artificial Sequence: Synthetic oligonucleotide
  Target: AGXT; (+) strand; PAM type: YTN; PAM sequence: TTT
acttaccaggaaatcacaag

SEQ ID NO: 16692 - DNA, 20 bp, Artificial Sequence
  Description of Artificial Sequence: Synthetic oligonucleotide
  Target: AGXT; (+) strand; PAM type: YTN; PAM sequence: TTA
cttaccaggaaatcacaagt

SEQ ID NO: 16693 - DNA, 20 bp, Artificial Sequence
  Description of Artificial Sequence: Synthetic oligonucleotide
  Target: AGXT; (+) strand; PAM type: YTN; PAM sequence: CTT
accaggaaatcacaagtaag

SEQ ID NO: 16694 - DNA, 20 bp, Artificial Sequence
  Description of Artificial Sequence: Synthetic oligonucleotide
  Target: AGXT; (+) strand; PAM type: YTN; PAM sequence: TTA
ccaggaaatcacaagtaaga

SEQ ID NO: 16695 - DNA, 20 bp, Artificial Sequence
  Description of Artificial Sequence: Synthetic oligonucleotide
  Target: AGXT; (+) strand; PAM type: YTN; PAM sequence: CTA
ccgcctcccttgaaatagca

SEQ ID NO: 16696 - DNA, 20 bp, Artificial Sequence
  Description of Artificial Sequence: Synthetic oligonucleotide
  Target: AGXT; (+) strand; PAM type: YTN; PAM sequence: CTC
ccttgaaatagcaaaagctg

SEQ ID NO: 16697 - DNA, 20 bp, Artificial Sequence
  Description of Artificial Sequence: Synthetic oligonucleotide
  Target: AGXT; (+) strand; PAM type: YTN; PAM sequence: CTT
gaaatagcaaaagctggcac

SEQ ID NO: 16698 - DNA, 20 bp, Artificial Sequence
  Description of Artificial Sequence: Synthetic oligonucleotide
  Target: AGXT; (+) strand; PAM type: YTN; PAM sequence: TTG
aaatagcaaaagctggcacc

SEQ ID NO: 16699 - DNA, 20 bp, Artificial Sequence
  Description of Artificial Sequence: Synthetic oligonucleotide
  Target: AGXT; (+) strand; PAM type: YTN; PAM sequence: CTG
gcacccatctatcagctcta

SEQ ID NO: 16700 - DNA, 20 bp, Artificial Sequence
  Description of Artificial Sequence: Synthetic oligonucleotide
  Target: AGXT; (+) strand; PAM type: YTN; PAM sequence: CTA
tcagctctacaagtcattag

SEQ ID NO: 16701 - DNA, 20 bp, Artificial Sequence
  Description of Artificial Sequence: Synthetic oligonucleotide
  Target: AGXT; (+) strand; PAM type: YTN; PAM sequence: CTC
tacaagtcattagactcaca

SEQ ID NO: 16702 - DNA, 20 bp, Artificial Sequence
  Description of Artificial Sequence: Synthetic oligonucleotide
  Target: AGXT; (+) strand; PAM type: YTN; PAM sequence: CTA
caagtcattagactcacaag

SEQ ID NO: 16703 - DNA, 20 bp, Artificial Sequence
  Description of Artificial Sequence: Synthetic oligonucleotide
  Target: AGXT; (+) strand; PAM type: YTN; PAM sequence: TTA
gactcacaagcaggattttg

SEQ ID NO: 16704 - DNA, 20 bp, Artificial Sequence
  Description of Artificial Sequence: Synthetic oligonucleotide
  Target: AGXT; (+) strand; PAM type: YTN; PAM sequence: CTC
acaagcaggattttggtgtc

SEQ ID NO: 16705 - DNA, 20 bp, Artificial Sequence
  Description of Artificial Sequence: Synthetic oligonucleotide
  Target: AGXT; (+) strand; PAM type: YTN; PAM sequence: TTT
tggtgtctggtaacaggtga

SEQ ID NO: 16706 - DNA, 20 bp, Artificial Sequence
  Description of Artificial Sequence: Synthetic oligonucleotide
  Target: AGXT; (+) strand; PAM type: YTN; PAM sequence: TTT
ggtgtctggtaacaggtgag

SEQ ID NO: 16707 - DNA, 20 bp, Artificial Sequence
  Description of Artificial Sequence: Synthetic oligonucleotide
  Target: AGXT; (+) strand; PAM type: YTN; PAM sequence: TTG
gtgtctggtaacaggtgagt

SEQ ID NO: 16708 - DNA, 20 bp, Artificial Sequence
  Description of Artificial Sequence: Synthetic oligonucleotide
  Target: AGXT; (+) strand; PAM type: YTN; PAM sequence: CTG
gtaacaggtgagttctggat

SEQ ID NO: 16709 - DNA, 20 bp, Artificial Sequence
  Description of Artificial Sequence: Synthetic oligonucleotide
  Target: AGXT; (+) strand; PAM type: YTN; PAM sequence: TTC
tggattacctcctagctgaa

SEQ ID NO: 16710 - DNA, 20 bp, Artificial Sequence
  Description of Artificial Sequence: Synthetic oligonucleotide
  Target: AGXT; (+) strand; PAM type: YTN; PAM sequence: CTG
gattacctcctagctgaaca

SEQ ID NO: 16711 - DNA, 20 bp, Artificial Sequence
  Description of Artificial Sequence: Synthetic oligonucleotide
  Target: AGXT; (+) strand; PAM type: YTN; PAM sequence: TTA
cctcctagctgaacaaggag

SEQ ID NO: 16712 - DNA, 20 bp, Artificial Sequence
  Description of Artificial Sequence: Synthetic oligonucleotide
  Target: AGXT; (+) strand; PAM type: YTN; PAM sequence: CTC
ctagctgaacaaggaggggt

SEQ ID NO: 16713 - DNA, 20 bp, Artificial Sequence
  Description of Artificial Sequence: Synthetic oligonucleotide
  Target: AGXT; (+) strand; PAM type: YTN; PAM sequence: CTA
gctgaacaaggaggggtctg

SEQ ID NO: 16714 - DNA, 20 bp, Artificial Sequence
  Description of Artificial Sequence: Synthetic oligonucleotide
  Target: AGXT; (+) strand; PAM type: YTN; PAM sequence: CTG
aacaaggaggggtctgtgct

SEQ ID NO: 16715 - DNA, 20 bp, Artificial Sequence
  Description of Artificial Sequence: Synthetic oligonucleotide
  Target: AGXT; (+) strand; PAM type: YTN; PAM sequence: CTG
tgctgtcatcaacaggaccc

SEQ ID NO: 16716 - DNA, 20 bp, Artificial Sequence
  Description of Artificial Sequence: Synthetic oligonucleotide
  Target: AGXT; (+) strand; PAM type: YTN; PAM sequence: CTG
tcatcaacaggacccgttgc

SEQ ID NO: 16717 - DNA, 20 bp, Artificial Sequence
  Description of Artificial Sequence: Synthetic oligonucleotide
  Target: AGXT; (+) strand; PAM type: YTN; PAM sequence: TTG
cacctacatttatgtgtctg

SEQ ID NO: 16718 - DNA, 20 bp, Artificial Sequence
  Description of Artificial Sequence: Synthetic oligonucleotide
  Target: AGXT; (+) strand; PAM type: YTN; PAM sequence: CTA
catttatgtgtctggagaag

SEQ ID NO: 16719 - DNA, 20 bp, Artificial Sequence
  Description of Artificial Sequence: Synthetic oligonucleotide
  Target: AGXT; (+) strand; PAM type: YTN; PAM sequence: TTT
atgtgtctggagaagtggaa

SEQ ID NO: 16720 - DNA, 20 bp, Artificial Sequence
  Description of Artificial Sequence: Synthetic oligonucleotide
  Target: AGXT; (+) strand; PAM type: YTN; PAM sequence: TTA
tgtgtctggagaagtggaaa

SEQ ID NO: 16721 - DNA, 20 bp, Artificial Sequence
  Description of Artificial Sequence: Synthetic oligonucleotide
  Target: AGXT; (+) strand; PAM type: YTN; PAM sequence: CTG
gagaagtggaaaccgatgcc

SEQ ID NO: 16722 - DNA, 20 bp, Artificial Sequence
  Description of Artificial Sequence: Synthetic oligonucleotide
  Target: AGXT; (+) strand; PAM type: YTN; PAM sequence: CTA
cacacactttcccaaagcaa

SEQ ID NO: 16723 - DNA, 20 bp, Artificial Sequence
  Description of Artificial Sequence: Synthetic oligonucleotide
  Target: AGXT; (+) strand; PAM type: YTN; PAM sequence: CTT
tcccaaagcaaccaagactg

SEQ ID NO: 16724 - DNA, 20 bp, Artificial Sequence
  Description of Artificial Sequence: Synthetic oligonucleotide
  Target: AGXT; (+) strand; PAM type: YTN; PAM sequence: TTT
cccaaagcaaccaagactgg

SEQ ID NO: 16725 - DNA, 20 bp, Artificial Sequence
  Description of Artificial Sequence: Synthetic oligonucleotide
  Target: AGXT; (+) strand; PAM type: YTN; PAM sequence: TTC
ccaaagcaaccaagactggg

SEQ ID NO: 16726 - DNA, 20 bp, Artificial Sequence
  Description of Artificial Sequence: Synthetic oligonucleotide
  Target: AGXT; (+) strand; PAM type: YTN; PAM sequence: CTG
ggccaaaacttttactgatt

SEQ ID NO: 16727 - DNA, 20 bp, Artificial Sequence
  Description of Artificial Sequence: Synthetic oligonucleotide
  Target: AGXT; (+) strand; PAM type: YTN; PAM sequence: CTT
ttactgattggttttcaaaa

SEQ ID NO: 16728 - DNA, 20 bp, Artificial Sequence
  Description of Artificial Sequence: Synthetic oligonucleotide
  Target: AGXT; (+) strand; PAM type: YTN; PAM sequence: TTT
tactgattggttttcaaaaa

SEQ ID NO: 16729 - DNA, 20 bp, Artificial Sequence
  Description of Artificial Sequence: Synthetic oligonucleotide
  Target: AGXT; (+) strand; PAM type: YTN; PAM sequence: TTT
actgattggttttcaaaaaa

SEQ ID NO: 16730 - DNA, 20 bp, Artificial Sequence
  Description of Artificial Sequence: Synthetic oligonucleotide
  Target: AGXT; (+) strand; PAM type: YTN; PAM sequence: TTA
ctgattggttttcaaaaaat

SEQ ID NO: 16731 - DNA, 20 bp, Artificial Sequence
  Description of Artificial Sequence: Synthetic oligonucleotide
  Target: AGXT; (+) strand; PAM type: YTN; PAM sequence: CTG
attggttttcaaaaaatcac

SEQ ID NO: 16732 - DNA, 20 bp, Artificial Sequence
  Description of Artificial Sequence: Synthetic oligonucleotide
  Target: AGXT; (+) strand; PAM type: YTN; PAM sequence: TTG
gttttcaaaaaatcacttgg

SEQ ID NO: 16733 - DNA, 20 bp, Artificial Sequence
  Description of Artificial Sequence: Synthetic oligonucleotide
  Target: AGXT; (+) strand; PAM type: YTN; PAM sequence: TTT
tcaaaaaatcacttggcttc

SEQ ID NO: 16734 - DNA, 20 bp, Artificial Sequence
  Description of Artificial Sequence: Synthetic oligonucleotide
  Target: AGXT; (+) strand; PAM type: YTN; PAM sequence: TTT
caaaaaatcacttggcttcc

SEQ ID NO: 16735 - DNA, 20 bp, Artificial Sequence
  Description of Artificial Sequence: Synthetic oligonucleotide
  Target: AGXT; (+) strand; PAM type: YTN; PAM sequence: TTC
aaaaaatcacttggcttccc

SEQ ID NO: 16736 - DNA, 20 bp, Artificial Sequence
  Description of Artificial Sequence: Synthetic oligonucleotide
  Target: AGXT; (+) strand; PAM type: YTN; PAM sequence: CTT
ggcttcccccattccttaga

SEQ ID NO: 16737 - DNA, 20 bp, Artificial Sequence
  Description of Artificial Sequence: Synthetic oligonucleotide
  Target: AGXT; (+) strand; PAM type: YTN; PAM sequence: TTG
gcttcccccattccttagac

SEQ ID NO: 16738 - DNA, 20 bp, Artificial Sequence
  Description of Artificial Sequence: Synthetic oligonucleotide
  Target: AGXT; (+) strand; PAM type: YTN; PAM sequence: CTT
cccccattccttagaccttt

SEQ ID NO: 16739 - DNA, 20 bp, Artificial Sequence
  Description of Artificial Sequence: Synthetic oligonucleotide
  Target: AGXT; (+) strand; PAM type: YTN; PAM sequence: TTC
ccccattccttagaccttta

SEQ ID NO: 16740 - DNA, 20 bp, Artificial Sequence
  Description of Artificial Sequence: Synthetic oligonucleotide
  Target: AGXT; (+) strand; PAM type: YTN; PAM sequence: TTC
cttagacctttatcttctgt

SEQ ID NO: 16741 - DNA, 20 bp, Artificial Sequence
  Description of Artificial Sequence: Synthetic oligonucleotide
  Target: AGXT; (+) strand; PAM type: YTN; PAM sequence: CTT
agacctttatcttctgtcat

SEQ ID NO: 16742 - DNA, 20 bp, Artificial Sequence
  Description of Artificial Sequence: Synthetic oligonucleotide
  Target: AGXT; (+) strand; PAM type: YTN; PAM sequence: TTA
gacctttatcttctgtcatt

SEQ ID NO: 16743 - DNA, 20 bp, Artificial Sequence
  Description of Artificial Sequence: Synthetic oligonucleotide
  Target: AGXT; (+) strand; PAM type: YTN; PAM sequence: CTT
tatcttctgtcatttttctt

SEQ ID NO: 16744 - DNA, 20 bp, Artificial Sequence
  Description of Artificial Sequence: Synthetic oligonucleotide
  Target: AGXT; (+) strand; PAM type: YTN; PAM sequence: TTT
atcttctgtcatttttcttt

SEQ ID NO: 16745 - DNA, 20 bp, Artificial Sequence
  Description of Artificial Sequence: Synthetic oligonucleotide
  Target: AGXT; (+) strand; PAM type: YTN; PAM sequence: TTA
tcttctgtcatttttctttt

SEQ ID NO: 16746 - DNA, 20 bp, Artificial Sequence
  Description of Artificial Sequence: Synthetic oligonucleotide
  Target: AGXT; (+) strand; PAM type: YTN; PAM sequence: CTT
ctgtcatttttcttttaata

SEQ ID NO: 16747 - DNA, 20 bp, Artificial Sequence
  Description of Artificial Sequence: Synthetic oligonucleotide
  Target: AGXT; (+) strand; PAM type: YTN; PAM sequence: TTC
tgtcatttttcttttaatat

SEQ ID NO: 16748 - DNA, 20 bp, Artificial Sequence
  Description of Artificial Sequence: Synthetic oligonucleotide
  Target: AGXT; (+) strand; PAM type: YTN; PAM sequence: CTG
tcatttttcttttaatattt

SEQ ID NO: 16749 - DNA, 20 bp, Artificial Sequence
  Description of Artificial Sequence: Synthetic oligonucleotide
  Target: AGXT; (+) strand; PAM type: YTN; PAM sequence: TTT
ttcttttaatatttggtccc

SEQ ID NO: 16750 - DNA, 20 bp, Artificial Sequence
  Description of Artificial Sequence: Synthetic oligonucleotide
  Target: AGXT; (+) strand; PAM type: YTN; PAM sequence: TTT
tcttttaatatttggtccct

SEQ ID NO: 16751 - DNA, 20 bp, Artificial Sequence
  Description of Artificial Sequence: Synthetic oligonucleotide
  Target: AGXT; (+) strand; PAM type: YTN; PAM sequence: TTT
cttttaatatttggtccctg

SEQ ID NO: 16752 - DNA, 20 bp, Artificial Sequence
  Description of Artificial Sequence: Synthetic oligonucleotide
  Target: AGXT; (+) strand; PAM type: YTN; PAM sequence: TTC
ttttaatatttggtccctgc

SEQ ID NO: 16753 - DNA, 20 bp, Artificial Sequence
  Description of Artificial Sequence: Synthetic oligonucleotide
  Target: AGXT; (+) strand; PAM type: YTN; PAM sequence: CTT
ttaatatttggtccctgcct

SEQ ID NO: 16754 - DNA, 20 bp, Artificial Sequence
  Description of Artificial Sequence: Synthetic oligonucleotide
  Target: AGXT; (+) strand; PAM type: YTN; PAM sequence: TTT
taatatttggtccctgcctt

SEQ ID NO: 16755 - DNA, 20 bp, Artificial Sequence
  Description of Artificial Sequence: Synthetic oligonucleotide
  Target: AGXT; (+) strand; PAM type: YTN; PAM sequence: TTT
aatatttggtccctgccttt

SEQ ID NO: 16756 - DNA, 20 bp, Artificial Sequence
  Description of Artificial Sequence: Synthetic oligonucleotide
  Target: AGXT; (+) strand; PAM type: YTN; PAM sequence: TTA
atatttggtccctgcctttt

SEQ ID NO: 16757 - DNA, 20 bp, Artificial Sequence
  Description of Artificial Sequence: Synthetic oligonucleotide
  Target: AGXT; (+) strand; PAM type: YTN; PAM sequence: TTT
ggtccctgcctttttaatgc

SEQ ID NO: 16758 - DNA, 20 bp, Artificial Sequence
  Description of Artificial Sequence: Synthetic oligonucleotide
  Target: AGXT; (+) strand; PAM type: YTN; PAM sequence: TTG
gtccctgcctttttaatgct

SEQ ID NO: 16759 - DNA, 20 bp, Artificial Sequence
  Description of Artificial Sequence: Synthetic oligonucleotide
  Target: AGXT; (+) strand; PAM type: YTN; PAM sequence: CTG
cctttttaatgctctgattg

SEQ ID NO: 16760 - DNA, 20 bp, Artificial Sequence
  Description of Artificial Sequence: Synthetic oligonucleotide
  Target: AGXT; (+) strand; PAM type: YTN; PAM sequence: CTT
tttaatgctctgattgcttt

SEQ ID NO: 16761 - DNA, 20 bp, Artificial Sequence
  Description of Artificial Sequence: Synthetic oligonucleotide
  Target: AGXT; (+) strand; PAM type: YTN; PAM sequence: TTT
ttaatgctctgattgctttt

SEQ ID NO: 16762 - DNA, 20 bp, Artificial Sequence
  Description of Artificial Sequence: Synthetic oligonucleotide
  Target: AGXT; (+) strand; PAM type: YTN; PAM sequence: TTT
taatgctctgattgcttttc

SEQ ID NO: 16763 - DNA, 20 bp, Artificial Sequence
  Description of Artificial Sequence: Synthetic oligonucleotide
  Target: AGXT; (+) strand; PAM type: YTN; PAM sequence: TTT
aatgctctgattgcttttct

SEQ ID NO: 16764 - DNA, 20 bp, Artificial Sequence
  Description of Artificial Sequence: Synthetic oligonucleotide
  Target: AGXT; (+) strand; PAM type: YTN; PAM sequence: TTA
atgctctgattgcttttcta

SEQ ID NO: 16765 - DNA, 20 bp, Artificial Sequence
  Description of Artificial Sequence: Synthetic oligonucleotide
  Target: AGXT; (+) strand; PAM type: YTN; PAM sequence: CTC
tgattgcttttctatgttct

SEQ ID NO: 16766 - DNA, 20 bp, Artificial Sequence
  Description of Artificial Sequence: Synthetic oligonucleotide
  Target: AGXT; (+) strand; PAM type: YTN; PAM sequence: CTG
attgcttttctatgttctac

SEQ ID NO: 16767 - DNA, 20 bp, Artificial Sequence
  Description of Artificial Sequence: Synthetic oligonucleotide
  Target: AGXT; (+) strand; PAM type: YTN; PAM sequence: TTG
cttttctatgttctacatga

SEQ ID NO: 16768 - DNA, 20 bp, Artificial Sequence
  Description of Artificial Sequence: Synthetic oligonucleotide
  Target: AGXT; (+) strand; PAM type: YTN; PAM sequence: CTT
ttctatgttctacatgagaa

SEQ ID NO: 16769 - DNA, 20 bp, Artificial Sequence
  Description of Artificial Sequence: Synthetic oligonucleotide
  Target: AGXT; (+) strand; PAM type: YTN; PAM sequence: TTT
tctatgttctacatgagaac

SEQ ID NO: 16770 - DNA, 20 bp, Artificial Sequence
  Description of Artificial Sequence: Synthetic oligonucleotide
  Target: AGXT; (+) strand; PAM type: YTN; PAM sequence: TTT
ctatgttctacatgagaaca

SEQ ID NO: 16771 - DNA, 20 bp, Artificial Sequence
  Description of Artificial Sequence: Synthetic oligonucleotide
  Target: AGXT; (+) strand; PAM type: YTN; PAM sequence: TTC
tatgttctacatgagaacaa

SEQ ID NO: 16772 - DNA, 20 bp, Artificial Sequence
  Description of Artificial Sequence: Synthetic oligonucleotide
  Target: AGXT; (+) strand; PAM type: YTN; PAM sequence: CTA
tgttctacatgagaacaatt

SEQ ID NO: 16773 - DNA, 20 bp, Artificial Sequence
  Description of Artificial Sequence: Synthetic oligonucleotide
  Target: AGXT; (+) strand; PAM type: YTN; PAM sequence: TTC
tacatgagaacaattccacc

SEQ ID NO: 16774 - DNA, 20 bp, Artificial Sequence
  Description of Artificial Sequence: Synthetic oligonucleotide
  Target: AGXT; (+) strand; PAM type: YTN; PAM sequence: CTA
catgagaacaattccacctg

SEQ ID NO: 16775 - DNA, 20 bp, Artificial Sequence
  Description of Artificial Sequence: Synthetic oligonucleotide
  Target: AGXT; (+) strand; PAM type: YTN; PAM sequence: TTC
cacctgcagaaggctatgca

SEQ ID NO: 16776 - DNA, 20 bp, Artificial Sequence
  Description of Artificial Sequence: Synthetic oligonucleotide
  Target: AGXT; (+) strand; PAM type: YTN; PAM sequence: CTG
cagaaggctatgcattccca

SEQ ID NO: 16777 - DNA, 20 bp, Artificial Sequence
  Description of Artificial Sequence: Synthetic oligonucleotide
  Target: AGXT; (+) strand; PAM type: YTN; PAM sequence: CTA
tgcattcccaacactggcct

SEQ ID NO: 16778 - DNA, 20 bp, Artificial Sequence
  Description of Artificial Sequence: Synthetic oligonucleotide
  Target: AGXT; (+) strand; PAM type: YTN; PAM sequence: TTC
ccaacactggcctgcaactg

SEQ ID NO: 16779 - DNA, 20 bp, Artificial Sequence
  Description of Artificial Sequence: Synthetic oligonucleotide
  Target: AGXT; (+) strand; PAM type: YTN; PAM sequence: CTG
gcctgcaactgcagctcgat

SEQ ID NO: 16780 - DNA, 20 bp, Artificial Sequence
  Description of Artificial Sequence: Synthetic oligonucleotide
  Target: AGXT; (+) strand; PAM type: YTN; PAM sequence: CTG
caactgcagctcgatttaca

SEQ ID NO: 16781 - DNA, 20 bp, Artificial Sequence
  Description of Artificial Sequence: Synthetic oligonucleotide
  Target: AGXT; (+) strand; PAM type: YTN; PAM sequence: CTG
cagctcgatttacatggggc

SEQ ID NO: 16782 - DNA, 20 bp, Artificial Sequence
  Description of Artificial Sequence: Synthetic oligonucleotide
  Target: AGXT; (+) strand; PAM type: YTN; PAM sequence: CTC
gatttacatggggcttcttg

SEQ ID NO: 16783 - DNA, 20 bp, Artificial Sequence
  Description of Artificial Sequence: Synthetic oligonucleotide
  Target: AGXT; (+) strand; PAM type: YTN; PAM sequence: TTT
acatggggcttcttgatgga

SEQ ID NO: 16784 - DNA, 20 bp, Artificial Sequence
  Description of Artificial Sequence: Synthetic oligonucleotide
  Target: AGXT; (+) strand; PAM type: YTN; PAM sequence: TTA
catggggcttcttgatggaa

SEQ ID NO: 16785 - DNA, 20 bp, Artificial Sequence
  Description of Artificial Sequence: Synthetic oligonucleotide
  Target: AGXT; (+) strand; PAM type: YTN; PAM sequence: CTT
cttgatggaaataccggcct

SEQ ID NO: 16786 - DNA, 20 bp, Artificial Sequence
  Description of Artificial Sequence: Synthetic oligonucleotide
  Target: AGXT; (+) strand; PAM type: YTN; PAM sequence: TTC
ttgatggaaataccggcctg

SEQ ID NO: 16787 - DNA, 20 bp, Artificial Sequence
  Description of Artificial Sequence: Synthetic oligonucleotide
  Target: AGXT; (+) strand; PAM type: YTN; PAM sequence: CTT
gatggaaataccggcctgca

SEQ ID NO: 16788 - DNA, 20 bp, Artificial Sequence
  Description of Artificial Sequence: Synthetic oligonucleotide
  Target: AGXT; (+) strand; PAM type: YTN; PAM sequence: TTG
atggaaataccggcctgcaa

SEQ ID NO: 16789 - DNA, 20 bp, Artificial Sequence
  Description of Artificial Sequence: Synthetic oligonucleotide
  Target: AGXT; (+) strand; PAM type: YTN; PAM sequence: CTG
caactgcagctcccatttac

SEQ ID NO: 16790 - DNA, 20 bp, Artificial Sequence
  Description of Artificial Sequence: Synthetic oligonucleotide
  Target: AGXT; (+) strand; PAM type: YTN; PAM sequence: CTG
cagctcccatttacgtgggg

SEQ ID NO: 16791 - DNA, 20 bp, Artificial Sequence
  Description of Artificial Sequence: Synthetic oligonucleotide
  Target: AGXT; (+) strand; PAM type: YTN; PAM sequence: CTC
ccatttacgtggggcttctt

SEQ ID NO: 16792 - DNA, 20 bp, Artificial Sequence
  Description of Artificial Sequence: Synthetic oligonucleotide
  Target: AGXT; (+) strand; PAM type: YTN; PAM sequence: TTT
acgtggggcttcttgatgga

SEQ ID NO: 16793 - DNA, 20 bp, Artificial Sequence
  Description of Artificial Sequence: Synthetic oligonucleotide
  Target: AGXT; (+) strand; PAM type: YTN; PAM sequence: TTA
cgtggggcttcttgatggaa

SEQ ID NO: 16794 - DNA, 20 bp, Artificial Sequence
  Description of Artificial Sequence: Synthetic oligonucleotide
  Target: AGXT; (+) strand; PAM type: YTN; PAM sequence: CTT
cttgatggaatcccatcacg

SEQ ID NO: 16795 - DNA, 20 bp, Artificial Sequence
  Description of Artificial Sequence: Synthetic oligonucleotide
  Target: AGXT; (+) strand; PAM type: YTN; PAM sequence: TTC
ttgatggaatcccatcacgt

SEQ ID NO: 16796 - DNA, 20 bp, Artificial Sequence
  Description of Artificial Sequence: Synthetic oligonucleotide
  Target: AGXT; (+) strand; PAM type: YTN; PAM sequence: CTT
gatggaatcccatcacgtgc

SEQ ID NO: 16797 - DNA, 20 bp, Artificial Sequence
  Description of Artificial Sequence: Synthetic oligonucleotide
  Target: AGXT; (+) strand; PAM type: YTN; PAM sequence: TTG
atggaatcccatcacgtgcc

SEQ ID NO: 16798 - DNA, 20 bp, Artificial Sequence
  Description of Artificial Sequence: Synthetic oligonucleotide
  Target: AGXT; (+) strand; PAM type: YTN; PAM sequence: CTC
cgtgcacaagttttcatgac

SEQ ID NO: 16799 - DNA, 20 bp, Artificial Sequence
  Description of Artificial Sequence: Synthetic oligonucleotide
  Target: AGXT; (+) strand; PAM type: YTN; PAM sequence: TTT
tcatgaccctttattccctt

SEQ ID NO: 16800 - DNA, 20 bp, Artificial Sequence
  Description of Artificial Sequence: Synthetic oligonucleotide
  Target: AGXT; (+) strand; PAM type: YTN; PAM sequence: TTT
catgaccctttattcccttc

SEQ ID NO: 16801 - DNA, 20 bp, Artificial Sequence
  Description of Artificial Sequence: Synthetic oligonucleotide
  Target: AGXT; (+) strand; PAM type: YTN; PAM sequence: TTC
atgaccctttattcccttca

SEQ ID NO: 16802 - DNA, 20 bp, Artificial Sequence
  Description of Artificial Sequence: Synthetic oligonucleotide
  Target: AGXT; (+) strand; PAM type: YTN; PAM sequence: CTT
tattcccttcatgaccgaga

SEQ ID NO: 16803 - DNA, 20 bp, Artificial Sequence
  Description of Artificial Sequence: Synthetic oligonucleotide
  Target: AGXT; (+) strand; PAM type: YTN; PAM sequence: TTT
attcccttcatgaccgagag

SEQ ID NO: 16804 - DNA, 20 bp, Artificial Sequence
  Description of Artificial Sequence: Synthetic oligonucleotide
  Target: AGXT; (+) strand; PAM type: YTN; PAM sequence: TTA
ttcccttcatgaccgagagc

SEQ ID NO: 16805 - DNA, 20 bp, Artificial Sequence
  Description of Artificial Sequence: Synthetic oligonucleotide
  Target: AGXT; (+) strand; PAM type: YTN; PAM sequence: TTC
ccttcatgaccgagagcaag

SEQ ID NO: 16806 - DNA, 20 bp, Artificial Sequence
  Description of Artificial Sequence: Synthetic oligonucleotide
  Target: AGXT; (+) strand; PAM type: YTN; PAM sequence: CTT
catgaccgagagcaagaaag

SEQ ID NO: 16807 - DNA, 20 bp, Artificial Sequence
  Description of Artificial Sequence: Synthetic oligonucleotide
  Target: AGXT; (+) strand; PAM type: YTN; PAM sequence: TTC
atgaccgagagcaagaaagg

SEQ ID NO: 16808 - DNA, 20 bp, Artificial Sequence
  Description of Artificial Sequence: Synthetic oligonucleotide
  Target: AGXT; (+) strand; PAM type: YTN; PAM sequence: CTA
cccccctgaactccctttca

SEQ ID NO: 16809 - DNA, 20 bp, Artificial Sequence
  Description of Artificial Sequence: Synthetic oligonucleotide
  Target: AGXT; (+) strand; PAM type: YTN; PAM sequence: CTG
aactccctttcagcagcaag

SEQ ID NO: 16810 - DNA, 20 bp, Artificial Sequence
  Description of Artificial Sequence: Synthetic oligonucleotide
  Target: AGXT; (+) strand; PAM type: YTN; PAM sequence: CTC
cctttcagcagcaagtagtc

SEQ ID NO: 16811 - DNA, 20 bp, Artificial Sequence
  Description of Artificial Sequence: Synthetic oligonucleotide
  Target: AGXT; (+) strand; PAM type: YTN; PAM sequence: CTT
tcagcagcaagtagtcaggc

SEQ ID NO: 16812 - DNA, 20 bp, Artificial Sequence
  Description of Artificial Sequence: Synthetic oligonucleotide
  Target: AGXT; (+) strand; PAM type: YTN; PAM sequence: TTT
cagcagcaagtagtcaggcg

SEQ ID NO: 16813 - DNA, 20 bp, Artificial Sequence
  Description of Artificial Sequence: Synthetic oligonucleotide
  Target: AGXT; (+) strand; PAM type: YTN; PAM sequence: TTC
agcagcaagtagtcaggcgc

SEQ ID NO: 16814 - DNA, 20 bp, Artificial Sequence
  Description of Artificial Sequence: Synthetic oligonucleotide
  Target: AGXT; (+) strand; PAM type: YTN; PAM sequence: CTG
gacacccctcttcactgtgc

SEQ ID NO: 16815 - DNA, 20 bp, Artificial Sequence
  Description of Artificial Sequence: Synthetic oligonucleotide
  Target: AGXT; (+) strand; PAM type: YTN; PAM sequence: CTC
ttcactgtgccgtttcccct

SEQ ID NO: 16816 - DNA, 20 bp, Artificial Sequence
  Description of Artificial Sequence: Synthetic oligonucleotide
  Target: AGXT; (+) strand; PAM type: YTN; PAM sequence: CTT
cactgtgccgtttccccttt

SEQ ID NO: 16817 - DNA, 20 bp, Artificial Sequence
  Description of Artificial Sequence: Synthetic oligonucleotide
  Target: AGXT; (+) strand; PAM type: YTN; PAM sequence: TTC
actgtgccgtttcccctttc

SEQ ID NO: 16818 - DNA, 20 bp, Artificial Sequence
  Description of Artificial Sequence: Synthetic oligonucleotide
  Target: AGXT; (+) strand; PAM type: YTN; PAM sequence: CTG
tgccgtttcccctttcttga

SEQ ID NO: 16819 - DNA, 20 bp, Artificial Sequence
  Description of Artificial Sequence: Synthetic oligonucleotide
  Target: AGXT; (+) strand; PAM type: YTN; PAM sequence: TTT
cccctttcttgagaccccaa

SEQ ID NO: 16820 - DNA, 20 bp, Artificial Sequence
  Description of Artificial Sequence: Synthetic oligonucleotide
  Target: AGXT; (+) strand; PAM type: YTN; PAM sequence: TTC
ccctttcttgagaccccaac

SEQ ID NO: 16821 - DNA, 20 bp, Artificial Sequence
  Description of Artificial Sequence: Synthetic oligonucleotide
  Target: AGXT; (+) strand; PAM type: YTN; PAM sequence: CTT
tcttgagaccccaacaggaa

SEQ ID NO: 16822 - DNA, 20 bp, Artificial Sequence
  Description of Artificial Sequence: Synthetic oligonucleotide
  Target: AGXT; (+) strand; PAM type: YTN; PAM sequence: TTT
cttgagaccccaacaggaag

SEQ ID NO: 16823 - DNA, 20 bp, Artificial Sequence
  Description of Artificial Sequence: Synthetic oligonucleotide
  Target: AGXT; (+) strand; PAM type: YTN; PAM sequence: TTC
ttgagaccccaacaggaagc

SEQ ID NO: 16824 - DNA, 20 bp, Artificial Sequence
  Description of Artificial Sequence: Synthetic oligonucleotide
  Target: AGXT; (+) strand; PAM type: YTN; PAM sequence: CTT
gagaccccaacaggaagcag

SEQ ID NO: 16825 - DNA, 20 bp, Artificial Sequence
  Description of Artificial Sequence: Synthetic oligonucleotide
  Target: AGXT; (+) strand; PAM type: YTN; PAM sequence: TTG
agaccccaacaggaagcagg

SEQ ID NO: 16826 - DNA, 20 bp, Artificial Sequence
  Description of Artificial Sequence: Synthetic oligonucleotide
  Target: AGXT; (+) strand; PAM type: YTN; PAM sequence: TTT
caccaagatatttgtcagag

SEQ ID NO: 16827 - DNA, 20 bp, Artificial Sequence
  Description of Artificial Sequence: Synthetic oligonucleotide
  Target: AGXT; (+) strand; PAM type: YTN; PAM sequence: TTC
accaagatatttgtcagagg

SEQ ID NO: 16828 - DNA, 20 bp, Artificial Sequence
  Description of Artificial Sequence: Synthetic oligonucleotide
  Target: AGXT; (+) strand; PAM type: YTN; PAM sequence: TTT
gtcagagggaaaatgaggac

SEQ ID NO: 16829 - DNA, 20 bp, Artificial Sequence
  Description of Artificial Sequence: Synthetic oligonucleotide
  Target: AGXT; (+) strand; PAM type: YTN; PAM sequence: TTG
tcagagggaaaatgaggaca

SEQ ID NO: 16830 - DNA, 20 bp, Artificial Sequence
  Description of Artificial Sequence: Synthetic oligonucleotide
  Target: AGXT; (+) strand; PAM type: YTN; PAM sequence: CTG
gagaccatcaagcaggcccc

SEQ ID NO: 16831 - DNA, 20 bp, Artificial Sequence
  Description of Artificial Sequence: Synthetic oligonucleotide
  Target: AGXT; (+) strand; PAM type: YTN; PAM sequence: CTC
tttatttgagaaatgtagaa

SEQ ID NO: 16832 - DNA, 20 bp, Artificial Sequence
  Description of Artificial Sequence: Synthetic oligonucleotide
  Target: AGXT; (+) strand; PAM type: YTN; PAM sequence: CTT
tatttgagaaatgtagaatg

SEQ ID NO: 16833 - DNA, 20 bp, Artificial Sequence
  Description of Artificial Sequence: Synthetic oligonucleotide
  Target: AGXT; (+) strand; PAM type: YTN; PAM sequence: TTT
atttgagaaatgtagaatga

SEQ ID NO: 16834 - DNA, 20 bp, Artificial Sequence
  Description of Artificial Sequence: Synthetic oligonucleotide
  Target: AGXT; (+) strand; PAM type: YTN; PAM sequence: TTA
tttgagaaatgtagaatgaa

SEQ ID NO: 16835 - DNA, 20 bp, Artificial Sequence
  Description of Artificial Sequence: Synthetic oligonucleotide
  Target: AGXT; (+) strand; PAM type: YTN; PAM sequence: TTT
gagaaatgtagaatgaatta

SEQ ID NO: 16836 - DNA, 20 bp, Artificial Sequence
  Description of Artificial Sequence: Synthetic oligonucleotide
  Target: AGXT; (+) strand; PAM type: YTN; PAM sequence: TTG
agaaatgtagaatgaattag

SEQ ID NO: 16837 - DNA, 20 bp, Artificial Sequence
  Description of Artificial Sequence: Synthetic oligonucleotide
  Target: AGXT; (+) strand; PAM type: YTN; PAM sequence: TTA
gacttccctattatctaaag

SEQ ID NO: 16838 - DNA, 20 bp, Artificial Sequence
  Description of Artificial Sequence: Synthetic oligonucleotide
  Target: AGXT; (+) strand; PAM type: YTN; PAM sequence: CTT
ccctattatctaaagttggc

SEQ ID NO: 16839 - DNA, 20 bp, Artificial Sequence
  Description of Artificial Sequence: Synthetic oligonucleotide
  Target: AGXT; (+) strand; PAM type: YTN; PAM sequence: TTC
cctattatctaaagttggca

SEQ ID NO: 16840 - DNA, 20 bp, Artificial Sequence
  Description of Artificial Sequence: Synthetic oligonucleotide
  Target: AGXT; (+) strand; PAM type: YTN; PAM sequence: CTA
ttatctaaagttggcacctg

SEQ ID NO: 16841 - DNA, 20 bp, Artificial Sequence
  Description of Artificial Sequence: Synthetic oligonucleotide
  Target: AGXT; (+) strand; PAM type: YTN; PAM sequence: TTA
tctaaagttggcacctggtt

SEQ ID NO: 16842 - DNA, 20 bp, Artificial Sequence
  Description of Artificial Sequence: Synthetic oligonucleotide
  Target: AGXT; (+) strand; PAM type: YTN; PAM sequence: CTA
aagttggcacctggttccag

SEQ ID NO: 16843 - DNA, 20 bp, Artificial Sequence
  Description of Artificial Sequence: Synthetic oligonucleotide
  Target: AGXT; (+) strand; PAM type: YTN; PAM sequence: TTG
gcacctggttccaggcctct

SEQ ID NO: 16844 - DNA, 20 bp, Artificial Sequence
  Description of Artificial Sequence: Synthetic oligonucleotide
  Target: AGXT; (+) strand; PAM type: YTN; PAM sequence: CTG
gttccaggcctcttttcaac

SEQ ID NO: 16845 - DNA, 20 bp, Artificial Sequence
  Description of Artificial Sequence: Synthetic oligonucleotide
  Target: AGXT; (+) strand; PAM type: YTN; PAM sequence: TTC
caggcctcttttcaacctaa

SEQ ID NO: 16846 - DNA, 20 bp, Artificial Sequence
  Description of Artificial Sequence: Synthetic oligonucleotide
  Target: AGXT; (+) strand; PAM type: YTN; PAM sequence: CTC
ttttcaacctaaaacttata

SEQ ID NO: 16847 - DNA, 20 bp, Artificial Sequence
  Description of Artificial Sequence: Synthetic oligonucleotide
  Target: AGXT; (+) strand; PAM type: YTN; PAM sequence: CTT
ttcaacctaaaacttataca

SEQ ID NO: 16848 - DNA, 20 bp, Artificial Sequence
  Description of Artificial Sequence: Synthetic oligonucleotide
  Target: AGXT; (+) strand; PAM type: YTN; PAM sequence: TTT
tcaacctaaaacttatacat

SEQ ID NO: 16849 - DNA, 20 bp, Artificial Sequence
  Description of Artificial Sequence: Synthetic oligonucleotide
  Target: AGXT; (+) strand; PAM type: YTN; PAM sequence: TTT
caacctaaaacttatacata

SEQ ID NO: 16850 - DNA, 20 bp, Artificial Sequence
  Description of Artificial Sequence: Synthetic oligonucleotide
  Target: AGXT; (+) strand; PAM type: YTN; PAM sequence: TTC
aacctaaaacttatacataa

SEQ ID NO: 16851 - DNA, 20 bp, Artificial Sequence
  Description of Artificial Sequence: Synthetic oligonucleotide
  Target: AGXT; (+) strand; PAM type: YTN; PAM sequence: CTA
aaacttatacataactagaa

SEQ ID NO: 16852 - DNA, 20 bp, Artificial Sequence
  Description of Artificial Sequence: Synthetic oligonucleotide
  Target: AGXT; (+) strand; PAM type: YTN; PAM sequence: CTT
atacataactagaatttcta

SEQ ID NO: 16853 - DNA, 20 bp, Artificial Sequence
  Description of Artificial Sequence: Synthetic oligonucleotide
  Target: AGXT; (+) strand; PAM type: YTN; PAM sequence: TTA
tacataactagaatttctat

SEQ ID NO: 16854 - DNA, 20 bp, Artificial Sequence
  Description of Artificial Sequence: Synthetic oligonucleotide
  Target: AGXT; (+) strand; PAM type: YTN; PAM sequence: CTA
gaatttctatacatctctgg

SEQ ID NO: 16855 - DNA, 20 bp, Artificial Sequence
  Description of Artificial Sequence: Synthetic oligonucleotide
  Target: AGXT; (+) strand; PAM type: YTN; PAM sequence: TTT
ctatacatctctggaatgca

SEQ ID NO: 16856 - DNA, 20 bp, Artificial Sequence
  Description of Artificial Sequence: Synthetic oligonucleotide
  Target: AGXT; (+) strand; PAM type: YTN; PAM sequence: TTC
tatacatctctggaatgcag

SEQ ID NO: 16857 - DNA, 20 bp, Artificial Sequence
  Description of Artificial Sequence: Synthetic oligonucleotide
  Target: AGXT; (+) strand; PAM type: YTN; PAM sequence: CTA
tacatctctggaatgcagca

SEQ ID NO: 16858 - DNA, 20 bp, Artificial Sequence
  Description of Artificial Sequence: Synthetic oligonucleotide
  Target: AGXT; (+) strand; PAM type: YTN; PAM sequence: CTC
tggaatgcagcatgctgaaa

SEQ ID NO: 16859 - DNA, 20 bp, Artificial Sequence
  Description of Artificial Sequence: Synthetic oligonucleotide
  Target: AGXT; (+) strand; PAM type: YTN; PAM sequence: CTG
gaatgcagcatgctgaaact

SEQ ID NO: 16860 - DNA, 20 bp, Artificial Sequence
  Description of Artificial Sequence: Synthetic oligonucleotide
  Target: AGXT; (+) strand; PAM type: YTN; PAM sequence: CTG
aaactcactgtgcaacccct

SEQ ID NO: 16861 - DNA, 20 bp, Artificial Sequence
  Description of Artificial Sequence: Synthetic oligonucleotide
  Target: AGXT; (+) strand; PAM type: YTN; PAM sequence: CTC
actgtgcaacccctgccttg

SEQ ID NO: 16862 - DNA, 20 bp, Artificial Sequence
  Description of Artificial Sequence: Synthetic oligonucleotide
  Target: AGXT; (+) strand; PAM type: YTN; PAM sequence: CTG
tgcaacccctgccttgtgtg

SEQ ID NO: 16863 - DNA, 20 bp, Artificial Sequence
  Description of Artificial Sequence: Synthetic oligonucleotide
  Target: AGXT; (+) strand; PAM type: YTN; PAM sequence: CTG
ccttgtgtgtgtctgtatac

SEQ ID NO: 16864 - DNA, 20 bp, Artificial Sequence
  Description of Artificial Sequence: Synthetic oligonucleotide
  Target: AGXT; (+) strand; PAM type: YTN; PAM sequence: CTT
gtgtgtgtctgtataccatg

SEQ ID NO: 16865 - DNA, 20 bp, Artificial Sequence
  Description of Artificial Sequence: Synthetic oligonucleotide
  Target: AGXT; (+) strand; PAM type: YTN; PAM sequence: TTG
tgtgtgtctgtataccatgc

SEQ ID NO: 16866 - DNA, 20 bp, Artificial Sequence
  Description of Artificial Sequence: Synthetic oligonucleotide
  Target: AGXT; (+) strand; PAM type: YTN; PAM sequence: CTG
tataccatgcaggtttgctt

SEQ ID NO: 16867 - DNA, 20 bp, Artificial Sequence
  Description of Artificial Sequence: Synthetic oligonucleotide
  Target: AGXT; (+) strand; PAM type: YTN; PAM sequence: TTT
gcttgctaaattgagcctgt

SEQ ID NO: 16868 - DNA, 20 bp, Artificial Sequence
  Description of Artificial Sequence: Synthetic oligonucleotide
  Target: AGXT; (+) strand; PAM type: YTN; PAM sequence: TTG
cttgctaaattgagcctgta

SEQ ID NO: 16869 - DNA, 20 bp, Artificial Sequence
  Description of Artificial Sequence: Synthetic oligonucleotide
  Target: AGXT; (+) strand; PAM type: YTN; PAM sequence: CTT
gctaaattgagcctgtaaac

SEQ ID NO: 16870 - DNA, 20 bp, Artificial Sequence
  Description of Artificial Sequence: Synthetic oligonucleotide
  Target: AGXT; (+) strand; PAM type: YTN; PAM sequence: TTG
ctaaattgagcctgtaaacc

SEQ ID NO: 16871 - DNA, 20 bp, Artificial Sequence
  Description of Artificial Sequence: Synthetic oligonucleotide
  Target: AGXT; (+) strand; PAM type: YTN; PAM sequence: CTA
aattgagcctgtaaaccaaa

SEQ ID NO: 16872 - DNA, 20 bp, Artificial Sequence
  Description of Artificial Sequence: Synthetic oligonucleotide
  Target: AGXT; (+) strand; PAM type: YTN; PAM sequence: TTG
agcctgtaaaccaaaaagta

SEQ ID NO: 16873 - DNA, 20 bp, Artificial Sequence
  Description of Artificial Sequence: Synthetic oligonucleotide
  Target: AGXT; (+) strand; PAM type: YTN; PAM sequence: CTG
taaaccaaaaagtacctcaa

SEQ ID NO: 16874 - DNA, 20 bp, Artificial Sequence
  Description of Artificial Sequence: Synthetic oligonucleotide
  Target: AGXT; (+) strand; PAM type: YTN; PAM sequence: CTC
aaacaggtctcaattaattt

SEQ ID NO: 16875 - DNA, 20 bp, Artificial Sequence
  Description of Artificial Sequence: Synthetic oligonucleotide
  Target: AGXT; (+) strand; PAM type: YTN; PAM sequence: CTC
aattaatttagaaagttttt

SEQ ID NO: 16876 - DNA, 20 bp, Artificial Sequence
  Description of Artificial Sequence: Synthetic oligonucleotide
  Target: AGXT; (+) strand; PAM type: YTN; PAM sequence: TTA
atttagaaagtttttgttgc

SEQ ID NO: 16877 - DNA, 20 bp, Artificial Sequence
  Description of Artificial Sequence: Synthetic oligonucleotide
  Target: AGXT; (+) strand; PAM type: YTN; PAM sequence: TTT
agaaagtttttgttgccaag

SEQ ID NO: 16878 - DNA, 20 bp, Artificial Sequence
  Description of Artificial Sequence: Synthetic oligonucleotide
  Target: AGXT; (+) strand; PAM type: YTN; PAM sequence: TTA
gaaagtttttgttgccaagg

SEQ ID NO: 16879 - DNA, 20 bp, Artificial Sequence
  Description of Artificial Sequence: Synthetic oligonucleotide
  Target: AGXT; (+) strand; PAM type: YTN; PAM sequence: TTT
ttgttgccaaggctaaggat

SEQ ID NO: 16880 - DNA, 20 bp, Artificial Sequence
  Description of Artificial Sequence: Synthetic oligonucleotide
  Target: AGXT; (+) strand; PAM type: YTN; PAM sequence: TTT
tgttgccaaggctaaggatg

SEQ ID NO: 16881 - DNA, 20 bp, Artificial Sequence
  Description of Artificial Sequence: Synthetic oligonucleotide
  Target: AGXT; (+) strand; PAM type: YTN; PAM sequence: TTT
gttgccaaggctaaggatgc

SEQ ID NO: 16882 - DNA, 20 bp, Artificial Sequence
  Description of Artificial Sequence: Synthetic oligonucleotide
  Target: AGXT; (+) strand; PAM type: YTN; PAM sequence: TTG
ttgccaaggctaaggatgca

SEQ ID NO: 16883 - DNA, 20 bp, Artificial Sequence
  Description of Artificial Sequence: Synthetic oligonucleotide
  Target: AGXT; (+) strand; PAM type: YTN; PAM sequence: TTG
ccaaggctaaggatgcaccc

SEQ ID NO: 16884 - DNA, 20 bp, Artificial Sequence
  Description of Artificial Sequence: Synthetic oligonucleotide
  Target: AGXT; (+) strand; PAM type: YTN; PAM sequence: CTA
aggatgcacccgtggtacag

SEQ ID NO: 16885 - DNA, 20 bp, Artificial Sequence
  Description of Artificial Sequence: Synthetic oligonucleotide
  Target: AGXT; (+) strand; PAM type: YTN; PAM sequence: CTC
aggagggaggacatccttgc

SEQ ID NO: 16886 - DNA, 20 bp, Artificial Sequence
  Description of Artificial Sequence: Synthetic oligonucleotide
  Target: AGXT; (+) strand; PAM type: YTN; PAM sequence: CTT
gccaagctcaagggtgcacc

SEQ ID NO: 16887 - DNA, 20 bp, Artificial Sequence
  Description of Artificial Sequence: Synthetic oligonucleotide
  Target: AGXT; (+) strand; PAM type: YTN; PAM sequence: TTG
ccaagctcaagggtgcaccc

SEQ ID NO: 16888 - DNA, 20 bp, Artificial Sequence
  Description of Artificial Sequence: Synthetic oligonucleotide
  Target: AGXT; (+) strand; PAM type: YTN; PAM sequence: CTC
aagggtgcacccctgaccac

SEQ ID NO: 16889 - DNA, 20 bp, Artificial Sequence
  Description of Artificial Sequence: Synthetic oligonucleotide
  Target: AGXT; (+) strand; PAM type: YTN; PAM sequence: CTG
accacaagggcccaaggtgg

SEQ ID NO: 16890 - DNA, 20 bp, Artificial Sequence
  Description of Artificial Sequence: Synthetic oligonucleotide
  Target: AGXT; (+) strand; PAM type: YTN; PAM sequence: CTT
gcttttatacattttaggga

SEQ ID NO: 16891 - DNA, 20 bp, Artificial Sequence
  Description of Artificial Sequence: Synthetic oligonucleotide
  Target: AGXT; (+) strand; PAM type: YTN; PAM sequence: TTG
cttttatacattttagggag

SEQ ID NO: 16892 - DNA, 20 bp, Artificial Sequence
  Description of Artificial Sequence: Synthetic oligonucleotide
  Target: AGXT; (+) strand; PAM type: YTN; PAM sequence: CTT
ttatacattttagggagata

SEQ ID NO: 16893 - DNA, 20 bp, Artificial Sequence
  Description of Artificial Sequence: Synthetic oligonucleotide
  Target: AGXT; (+) strand; PAM type: YTN; PAM sequence: TTT
tatacattttagggagatat

SEQ ID NO: 16894 - DNA, 20 bp, Artificial Sequence
  Description of Artificial Sequence: Synthetic oligonucleotide
  Target: AGXT; (+) strand; PAM type: YTN; PAM sequence: TTT
atacattttagggagatatg

SEQ ID NO: 16895 - DNA, 20 bp, Artificial Sequence
  Description of Artificial Sequence: Synthetic oligonucleotide
  Target: AGXT; (+) strand; PAM type: YTN; PAM sequence: TTA
tacattttagggagatatga

SEQ ID NO: 16896 - DNA, 20 bp, Artificial Sequence
  Description of Artificial Sequence: Synthetic oligonucleotide
  Target: AGXT; (+) strand; PAM type: YTN; PAM sequence: TTT
tagggagatatgaggcatca

SEQ ID NO: 16897 - DNA, 20 bp, Artificial Sequence
  Description of Artificial Sequence: Synthetic oligonucleotide
  Target: AGXT; (+) strand; PAM type: YTN; PAM sequence: TTT
agggagatatgaggcatcaa

SEQ ID NO: 16898 - DNA, 20 bp, Artificial Sequence
  Description of Artificial Sequence: Synthetic oligonucleotide
  Target: AGXT; (+) strand; PAM type: YTN; PAM sequence: TTA
gggagatatgaggcatcaat

SEQ ID NO: 16899 - DNA, 20 bp, Artificial Sequence
  Description of Artificial Sequence: Synthetic oligonucleotide
  Target: AGXT; (+) strand; PAM type: YTN; PAM sequence: TTT
acattggttccatctggaag

SEQ ID NO: 16900 - DNA, 20 bp, Artificial Sequence
  Description of Artificial Sequence: Synthetic oligonucleotide
  Target: AGXT; (+) strand; PAM type: YTN; PAM sequence: TTA
cattggttccatctggaagg

SEQ ID NO: 16901 - DNA, 20 bp, Artificial Sequence
  Description of Artificial Sequence: Synthetic oligonucleotide
  Target: AGXT; (+) strand; PAM type: YTN; PAM sequence: TTG
gttccatctggaagggcggg

SEQ ID NO: 16902 - DNA, 20 bp, Artificial Sequence
  Description of Artificial Sequence: Synthetic oligonucleotide
  Target: AGXT; (+) strand; PAM type: YTN; PAM sequence: TTC
catctggaagggcgggacaa

SEQ ID NO: 16903 - DNA, 20 bp, Artificial Sequence
  Description of Artificial Sequence: Synthetic oligonucleotide
  Target: AGXT; (+) strand; PAM type: YTN; PAM sequence: CTG
gaagggcgggacaacttgaa

SEQ ID NO: 16904 - DNA, 20 bp, Artificial Sequence
  Description of Artificial Sequence: Synthetic oligonucleotide
  Target: AGXT; (+) strand; PAM type: YTN; PAM sequence: CTT
gaattggggggcttccaggt

SEQ ID NO: 16905 - DNA, 20 bp, Artificial Sequence
  Description of Artificial Sequence: Synthetic oligonucleotide
  Target: AGXT; (+) strand; PAM type: YTN; PAM sequence: TTG
aattggggggcttccaggtc

SEQ ID NO: 16906 - DNA, 20 bp, Artificial Sequence
  Description of Artificial Sequence: Synthetic oligonucleotide
  Target: AGXT; (+) strand; PAM type: YTN; PAM sequence: TTG
gggggcttccaggtcatagg

SEQ ID NO: 16907 - DNA, 20 bp, Artificial Sequence
  Description of Artificial Sequence: Synthetic oligonucleotide
  Target: AGXT; (+) strand; PAM type: YTN; PAM sequence: CTT
ccaggtcataggtagattta

SEQ ID NO: 16908 - DNA, 20 bp, Artificial Sequence
  Description of Artificial Sequence: Synthetic oligonucleotide
  Target: AGXT; (+) strand; PAM type: YTN; PAM sequence: TTC
caggtcataggtagatttaa

SEQ ID NO: 16909 - DNA, 20 bp, Artificial Sequence
  Description of Artificial Sequence: Synthetic oligonucleotide
  Target: AGXT; (+) strand; PAM type: YTN; PAM sequence: TTT
aaacatattttgattggcaa

SEQ ID NO: 16910 - DNA, 20 bp, Artificial Sequence
  Description of Artificial Sequence: Synthetic oligonucleotide
  Target: AGXT; (+) strand; PAM type: YTN; PAM sequence: TTA
aacatattttgattggcaac

SEQ ID NO: 16911 - DNA, 20 bp, Artificial Sequence
  Description of Artificial Sequence: Synthetic oligonucleotide
  Target: AGXT; (+) strand; PAM type: YTN; PAM sequence: TTT
tgattggcaactgactgaag

SEQ ID NO: 16912 - DNA, 20 bp, Artificial Sequence
  Description of Artificial Sequence: Synthetic oligonucleotide
  Target: AGXT; (+) strand; PAM type: YTN; PAM sequence: TTT
gattggcaactgactgaaga

SEQ ID NO: 16913 - DNA, 20 bp, Artificial Sequence
  Description of Artificial Sequence: Synthetic oligonucleotide
  Target: AGXT; (+) strand; PAM type: YTN; PAM sequence: TTG
attggcaactgactgaagaa

SEQ ID NO: 16914 - DNA, 20 bp, Artificial Sequence
  Description of Artificial Sequence: Synthetic oligonucleotide
  Target: AGXT; (+) strand; PAM type: YTN; PAM sequence: TTG
gcaactgactgaagaattat

SEQ ID NO: 16915 - DNA, 20 bp, Artificial Sequence
  Description of Artificial Sequence: Synthetic oligonucleotide
  Target: AGXT; (+) strand; PAM type: YTN; PAM sequence: CTG
actgaagaattattatcagc

SEQ ID NO: 16916 - DNA, 20 bp, Artificial Sequence
  Description of Artificial Sequence: Synthetic oligonucleotide
  Target: AGXT; (+) strand; PAM type: YTN; PAM sequence: CTG
aagaattattatcagcagaa

SEQ ID NO: 16917 - DNA, 20 bp, Artificial Sequence
  Description of Artificial Sequence: Synthetic oligonucleotide
  Target: AGXT; (+) strand; PAM type: YTN; PAM sequence: TTA
ttatcagcagaaaggagtgt

SEQ ID NO: 16918 - DNA, 20 bp, Artificial Sequence
  Description of Artificial Sequence: Synthetic oligonucleotide
  Target: AGXT; (+) strand; PAM type: YTN; PAM sequence: TTA
tcagcagaaaggagtgtctg

SEQ ID NO: 16919 - DNA, 20 bp, Artificial Sequence
  Description of Artificial Sequence: Synthetic oligonucleotide
  Target: AGXT; (+) strand; PAM type: YTN; PAM sequence: CTG
ggttatgaaataggggttgc

SEQ ID NO: 16920 - DNA, 20 bp, Artificial Sequence
  Description of Artificial Sequence: Synthetic oligonucleotide
  Target: AGXT; (+) strand; PAM type: YTN; PAM sequence: TTA
tgaaataggggttgcaggga

SEQ ID NO: 16921 - DNA, 20 bp, Artificial Sequence
  Description of Artificial Sequence: Synthetic oligonucleotide
  Target: AGXT; (+) strand; PAM type: YTN; PAM sequence: TTG
cagggagcagatgatgcctt

SEQ ID NO: 16922 - DNA, 20 bp, Artificial Sequence
  Description of Artificial Sequence: Synthetic oligonucleotide
  Target: AGXT; (+) strand; PAM type: YTN; PAM sequence: CTT
caggtagcgggatttagaga

SEQ ID NO: 16923 - DNA, 20 bp, Artificial Sequence
  Description of Artificial Sequence: Synthetic oligonucleotide
  Target: AGXT; (+) strand; PAM type: YTN; PAM sequence: TTC
aggtagcgggatttagagag

SEQ ID NO: 16924 - DNA, 20 bp, Artificial Sequence
  Description of Artificial Sequence: Synthetic oligonucleotide
  Target: AGXT; (+) strand; PAM type: YTN; PAM sequence: TTT
agagagaaaatagatggtaa

SEQ ID NO: 16925 - DNA, 20 bp, Artificial Sequence
  Description of Artificial Sequence: Synthetic oligonucleotide
  Target: AGXT; (+) strand; PAM type: YTN; PAM sequence: TTA
gagagaaaatagatggtaaa

SEQ ID NO: 16926 - DNA, 20 bp, Artificial Sequence
  Description of Artificial Sequence: Synthetic oligonucleotide
  Target: AGXT; (+) strand; PAM type: YTN; PAM sequence: CTT
cctatcagacttaaggtcta

SEQ ID NO: 16927 - DNA, 20 bp, Artificial Sequence
  Description of Artificial Sequence: Synthetic oligonucleotide
  Target: AGXT; (+) strand; PAM type: YTN; PAM sequence: TTC
ctatcagacttaaggtctat

SEQ ID NO: 16928 - DNA, 20 bp, Artificial Sequence
  Description of Artificial Sequence: Synthetic oligonucleotide
  Target: AGXT; (+) strand; PAM type: YTN; PAM sequence: CTA
tcagacttaaggtctatgtc

SEQ ID NO: 16929 - DNA, 20 bp, Artificial Sequence
  Description of Artificial Sequence: Synthetic oligonucleotide
  Target: AGXT; (+) strand; PAM type: YTN; PAM sequence: CTT
aaggtctatgtcgatgttaa

SEQ ID NO: 16930 - DNA, 20 bp, Artificial Sequence
  Description of Artificial Sequence: Synthetic oligonucleotide
  Target: AGXT; (+) strand; PAM type: YTN; PAM sequence: TTA
aggtctatgtcgatgttaat

SEQ ID NO: 16931 - DNA, 20 bp, Artificial Sequence
  Description of Artificial Sequence: Synthetic oligonucleotide
  Target: AGXT; (+) strand; PAM type: YTN; PAM sequence: CTA
tgtcgatgttaatgctgggg

SEQ ID NO: 16932 - DNA, 20 bp, Artificial Sequence
  Description of Artificial Sequence: Synthetic oligonucleotide
  Target: AGXT; (+) strand; PAM type: YTN; PAM sequence: TTA
atgctgggggttatgatgtg

SEQ ID NO: 16933 - DNA, 20 bp, Artificial Sequence
  Description of Artificial Sequence: Synthetic oligonucleotide
  Target: AGXT; (+) strand; PAM type: YTN; PAM sequence: CTG
ggggttatgatgtggcatgg

SEQ ID NO: 16934 - DNA, 20 bp, Artificial Sequence
  Description of Artificial Sequence: Synthetic oligonucleotide
  Target: AGXT; (+) strand; PAM type: YTN; PAM sequence: TTA
tgatgtggcatggcctgaac

SEQ ID NO: 16935 - DNA, 20 bp, Artificial Sequence
  Description of Artificial Sequence: Synthetic oligonucleotide
  Target: AGXT; (+) strand; PAM type: YTN; PAM sequence: CTG
aacgtcttccgggttaaagt

SEQ ID NO: 16936 - DNA, 20 bp, Artificial Sequence
  Description of Artificial Sequence: Synthetic oligonucleotide
  Target: AGXT; (+) strand; PAM type: YTN; PAM sequence: CTT
ccgggttaaagtttagagca

SEQ ID NO: 16937 - DNA, 20 bp, Artificial Sequence
  Description of Artificial Sequence: Synthetic oligonucleotide
  Target: AGXT; (+) strand; PAM type: YTN; PAM sequence: TTC
cgggttaaagtttagagcac

SEQ ID NO: 16938 - DNA, 20 bp, Artificial Sequence
  Description of Artificial Sequence: Synthetic oligonucleotide
  Target: AGXT; (+) strand; PAM type: YTN; PAM sequence: TTA
aagtttagagcaccctggcg

SEQ ID NO: 16939 - DNA, 20 bp, Artificial Sequence
  Description of Artificial Sequence: Synthetic oligonucleotide
  Target: AGXT; (+) strand; PAM type: YTN; PAM sequence: TTT
agagcaccctggcggacagg

SEQ ID NO: 16940 - DNA, 20 bp, Artificial Sequence
  Description of Artificial Sequence: Synthetic oligonucleotide
  Target: AGXT; (+) strand; PAM type: YTN; PAM sequence: TTA
gagcaccctggcggacaggg

SEQ ID NO: 16941 - DNA, 20 bp, Artificial Sequence
  Description of Artificial Sequence: Synthetic oligonucleotide
  Target: AGXT; (+) strand; PAM type: YTN; PAM sequence: CTG
gcggacagggaaccccattc

SEQ ID NO: 16942 - DNA, 20 bp, Artificial Sequence
  Description of Artificial Sequence: Synthetic oligonucleotide
  Target: AGXT; (+) strand; PAM type: YTN; PAM sequence: TTC
agatggttgctggggggcct

SEQ ID NO: 16943 - DNA, 20 bp, Artificial Sequence
  Description of Artificial Sequence: Synthetic oligonucleotide
  Target: AGXT; (+) strand; PAM type: YTN; PAM sequence: TTG
ctggggggccttcgaatttt

SEQ ID NO: 16944 - DNA, 20 bp, Artificial Sequence
  Description of Artificial Sequence: Synthetic oligonucleotide
  Target: AGXT; (+) strand; PAM type: YTN; PAM sequence: CTG
gggggccttcgaattttatt

SEQ ID NO: 16945 - DNA, 20 bp, Artificial Sequence
  Description of Artificial Sequence: Synthetic oligonucleotide
  Target: AGXT; (+) strand; PAM type: YTN; PAM sequence: CTT
cgaattttatttttggttta

SEQ ID NO: 16946 - DNA, 20 bp, Artificial Sequence
  Description of Artificial Sequence: Synthetic oligonucleotide
  Target: AGXT; (+) strand; PAM type: YTN; PAM sequence: TTC
gaattttatttttggtttac

SEQ ID NO: 16947 - DNA, 20 bp, Artificial Sequence
  Description of Artificial Sequence: Synthetic oligonucleotide
  Target: AGXT; (+) strand; PAM type: YTN; PAM sequence: TTT
tatttttggtttacaagcct

SEQ ID NO: 16948 - DNA, 20 bp, Artificial Sequence
  Description of Artificial Sequence: Synthetic oligonucleotide
  Target: AGXT; (+) strand; PAM type: YTN; PAM sequence: TTT
atttttggtttacaagcctt

SEQ ID NO: 16949 - DNA, 20 bp, Artificial Sequence
  Description of Artificial Sequence: Synthetic oligonucleotide
  Target: AGXT; (+) strand; PAM type: YTN; PAM sequence: TTA
tttttggtttacaagccttc

SEQ ID NO: 16950 - DNA, 20 bp, Artificial Sequence
  Description of Artificial Sequence: Synthetic oligonucleotide
  Target: AGXT; (+) strand; PAM type: YTN; PAM sequence: TTT
ttggtttacaagccttccca

SEQ ID NO: 16951 - DNA, 20 bp, Artificial Sequence
  Description of Artificial Sequence: Synthetic oligonucleotide
  Target: AGXT; (+) strand; PAM type: YTN; PAM sequence: TTT
tggtttacaagccttcccat

SEQ ID NO: 16952 - DNA, 20 bp, Artificial Sequence
  Description of Artificial Sequence: Synthetic oligonucleotide
  Target: AGXT; (+) strand; PAM type: YTN; PAM sequence: TTT
ggtttacaagccttcccatc

SEQ ID NO: 16953 - DNA, 20 bp, Artificial Sequence
  Description of Artificial Sequence: Synthetic oligonucleotide
  Target: AGXT; (+) strand; PAM type: YTN; PAM sequence: TTG
gtttacaagccttcccatca

SEQ ID NO: 16954 - DNA, 20 bp, Artificial Sequence
  Description of Artificial Sequence: Synthetic oligonucleotide
  Target: AGXT; (+) strand; PAM type: YTN; PAM sequence: TTT
acaagccttcccatcagctg

SEQ ID NO: 16955 - DNA, 20 bp, Artificial Sequence
  Description of Artificial Sequence: Synthetic oligonucleotide
  Target: AGXT; (+) strand; PAM type: YTN; PAM sequence: TTA
caagccttcccatcagctgc

SEQ ID NO: 16956 - DNA, 20 bp, Artificial Sequence
  Description of Artificial Sequence: Synthetic oligonucleotide
  Target: AGXT; (+) strand; PAM type: YTN; PAM sequence: CTT
cccatcagctgcgccagggt

SEQ ID NO: 16957 - DNA, 20 bp, Artificial Sequence
  Description of Artificial Sequence: Synthetic oligonucleotide
  Target: AGXT; (+) strand; PAM type: YTN; PAM sequence: TTC
ccatcagctgcgccagggtc

SEQ ID NO: 16958 - DNA, 20 bp, Artificial Sequence
  Description of Artificial Sequence: Synthetic oligonucleotide
  Target: AGXT; (+) strand; PAM type: YTN; PAM sequence: CTG
cgccagggtcagcaaaccac

SEQ ID NO: 16959 - DNA, 20 bp, Artificial Sequence
  Description of Artificial Sequence: Synthetic oligonucleotide
  Target: AGXT; (+) strand; PAM type: YTN; PAM sequence: CTG
gcctgccacctgctttttgt

SEQ ID NO: 16960 - DNA, 20 bp, Artificial Sequence
  Description of Artificial Sequence: Synthetic oligonucleotide
  Target: AGXT; (+) strand; PAM type: YTN; PAM sequence: CTG
ccacctgctttttgtaaata

SEQ ID NO: 16961 - DNA, 20 bp, Artificial Sequence
  Description of Artificial Sequence: Synthetic oligonucleotide
  Target: AGXT; (+) strand; PAM type: YTN; PAM sequence: CTG
ctttttgtaaataaagtttt

SEQ ID NO: 16962 - DNA, 20 bp, Artificial Sequence
  Description of Artificial Sequence: Synthetic oligonucleotide
  Target: AGXT; (+) strand; PAM type: YTN; PAM sequence: CTT
tttgtaaataaagttttata

SEQ ID NO: 16963 - DNA, 20 bp, Artificial Sequence
  Description of Artificial Sequence: Synthetic oligonucleotide
  Target: AGXT; (+) strand; PAM type: YTN; PAM sequence: TTT
ttgtaaataaagttttatag

SEQ ID NO: 16964 - DNA, 20 bp, Artificial Sequence
  Description of Artificial Sequence: Synthetic oligonucleotide
  Target: AGXT; (+) strand; PAM type: YTN; PAM sequence: TTT
tgtaaataaagttttatagg

SEQ ID NO: 16965 - DNA, 20 bp, Artificial Sequence
  Description of Artificial Sequence: Synthetic oligonucleotide
  Target: AGXT; (+) strand; PAM type: YTN; PAM sequence: TTT
gtaaataaagttttatagga

SEQ ID NO: 16966 - DNA, 20 bp, Artificial Sequence
  Description of Artificial Sequence: Synthetic oligonucleotide
  Target: AGXT; (+) strand; PAM type: YTN; PAM sequence: TTG
taaataaagttttataggaa

SEQ ID NO: 16967 - DNA, 20 bp, Artificial Sequence
  Description of Artificial Sequence: Synthetic oligonucleotide
  Target: AGXT; (+) strand; PAM type: YTN; PAM sequence: TTT
tataggaacacgcccacacc

SEQ ID NO: 16968 - DNA, 20 bp, Artificial Sequence
  Description of Artificial Sequence: Synthetic oligonucleotide
  Target: AGXT; (+) strand; PAM type: YTN; PAM sequence: TTT
ataggaacacgcccacacct

SEQ ID NO: 16969 - DNA, 20 bp, Artificial Sequence
  Description of Artificial Sequence: Synthetic oligonucleotide
  Target: AGXT; (+) strand; PAM type: YTN; PAM sequence: TTA
taggaacacgcccacacctc

SEQ ID NO: 16970 - DNA, 20 bp, Artificial Sequence
  Description of Artificial Sequence: Synthetic oligonucleotide
  Target: AGXT; (+) strand; PAM type: YTN; PAM sequence: CTC
tggcagctgctttgcaagca

SEQ ID NO: 16971 - DNA, 20 bp, Artificial Sequence
  Description of Artificial Sequence: Synthetic oligonucleotide
  Target: AGXT; (+) strand; PAM type: YTN; PAM sequence: CTG
gcagctgctttgcaagcacg

SEQ ID NO: 16972 - DNA, 20 bp, Artificial Sequence
  Description of Artificial Sequence: Synthetic oligonucleotide
  Target: AGXT; (+) strand; PAM type: YTN; PAM sequence: CTG
ctttgcaagcacgcagcagg

SEQ ID NO: 16973 - DNA, 20 bp, Artificial Sequence
  Description of Artificial Sequence: Synthetic oligonucleotide
  Target: AGXT; (+) strand; PAM type: YTN; PAM sequence: CTT
tgcaagcacgcagcagggtt

SEQ ID NO: 16974 - DNA, 20 bp, Artificial Sequence
  Description of Artificial Sequence: Synthetic oligonucleotide
  Target: AGXT; (+) strand; PAM type: YTN; PAM sequence: TTT
gcaagcacgcagcagggttg

SEQ ID NO: 16975 - DNA, 20 bp, Artificial Sequence
  Description of Artificial Sequence: Synthetic oligonucleotide
  Target: AGXT; (+) strand; PAM type: YTN; PAM sequence: TTG
caagcacgcagcagggttga

SEQ ID NO: 16976 - DNA, 20 bp, Artificial Sequence
  Description of Artificial Sequence: Synthetic oligonucleotide
  Target: AGXT; (+) strand; PAM type: YTN; PAM sequence: TTG
agttgttgcaacatagacca

SEQ ID NO: 16977 - DNA, 20 bp, Artificial Sequence
  Description of Artificial Sequence: Synthetic oligonucleotide
  Target: AGXT; (+) strand; PAM type: YTN; PAM sequence: TTG
ttgcaacatagaccacaggg

SEQ ID NO: 16978 - DNA, 20 bp, Artificial Sequence
  Description of Artificial Sequence: Synthetic oligonucleotide
  Target: AGXT; (+) strand; PAM type: YTN; PAM sequence: TTG
caacatagaccacagggcct

SEQ ID NO: 16979 - DNA, 20 bp, Artificial Sequence
  Description of Artificial Sequence: Synthetic oligonucleotide
  Target: AGXT; (+) strand; PAM type: YTN; PAM sequence: CTG
ccaagcctcaattatctgtg

SEQ ID NO: 16980 - DNA, 20 bp, Artificial Sequence
  Description of Artificial Sequence: Synthetic oligonucleotide
  Target: AGXT; (+) strand; PAM type: YTN; PAM sequence: CTC
aattatctgtgctccgaccc

SEQ ID NO: 16981 - DNA, 20 bp, Artificial Sequence
  Description of Artificial Sequence: Synthetic oligonucleotide
  Target: AGXT; (+) strand; PAM type: YTN; PAM sequence: TTA
tctgtgctccgaccctttaa

SEQ ID NO: 16982 - DNA, 20 bp, Artificial Sequence
  Description of Artificial Sequence: Synthetic oligonucleotide
  Target: AGXT; (+) strand; PAM type: YTN; PAM sequence: CTG
tgctccgaccctttaagaaa

SEQ ID NO: 16983 - DNA, 20 bp, Artificial Sequence
  Description of Artificial Sequence: Synthetic oligonucleotide
  Target: AGXT; (+) strand; PAM type: YTN; PAM sequence: CTC
cgaccctttaagaaacactt

SEQ ID NO: 16984 - DNA, 20 bp, Artificial Sequence
  Description of Artificial Sequence: Synthetic oligonucleotide
  Target: AGXT; (+) strand; PAM type: YTN; PAM sequence: CTT
taagaaacacttctctcacc

SEQ ID NO: 16985 - DNA, 20 bp, Artificial Sequence
  Description of Artificial Sequence: Synthetic oligonucleotide
  Target: AGXT; (+) strand; PAM type: YTN; PAM sequence: TTT
aagaaacacttctctcaccc

SEQ ID NO: 16986 - DNA, 20 bp, Artificial Sequence
  Description of Artificial Sequence: Synthetic oligonucleotide
  Target: AGXT; (+) strand; PAM type: YTN; PAM sequence: TTA
agaaacacttctctcacccc

SEQ ID NO: 16987 - DNA, 20 bp, Artificial Sequence
  Description of Artificial Sequence: Synthetic oligonucleotide
  Target: AGXT; (+) strand; PAM type: YTN; PAM sequence: CTT
ctctcacccctgagctaagc

SEQ ID NO: 16988 - DNA, 20 bp, Artificial Sequence
  Description of Artificial Sequence: Synthetic oligonucleotide
  Target: AGXT; (+) strand; PAM type: YTN; PAM sequence: TTC
tctcacccctgagctaagca

SEQ ID NO: 16989 - DNA, 20 bp, Artificial Sequence
  Description of Artificial Sequence: Synthetic oligonucleotide
  Target: AGXT; (+) strand; PAM type: YTN; PAM sequence: CTC
tcacccctgagctaagcaga

SEQ ID NO: 16990 - DNA, 20 bp, Artificial Sequence
  Description of Artificial Sequence: Synthetic oligonucleotide
  Target: AGXT; (+) strand; PAM type: YTN; PAM sequence: CTC
acccctgagctaagcagaat

SEQ ID NO: 16991 - DNA, 20 bp, Artificial Sequence
  Description of Artificial Sequence: Synthetic oligonucleotide
  Target: AGXT; (+) strand; PAM type: YTN; PAM sequence: CTG
agctaagcagaataagaggg

SEQ ID NO: 16992 - DNA, 20 bp, Artificial Sequence
  Description of Artificial Sequence: Synthetic oligonucleotide
  Target: AGXT; (+) strand; PAM type: YTN; PAM sequence: CTA
agcagaataagaggggctgg

SEQ ID NO: 16993 - DNA, 20 bp, Artificial Sequence
  Description of Artificial Sequence: Synthetic oligonucleotide
  Target: AGXT; (+) strand; PAM type: YTN; PAM sequence: CTG
gacgtgcaggactcagagtg

SEQ ID NO: 16994 - DNA, 20 bp, Artificial Sequence
  Description of Artificial Sequence: Synthetic oligonucleotide
  Target: AGXT; (+) strand; PAM type: YTN; PAM sequence: CTC
agagtgggagcgaggagggc

SEQ ID NO: 16995 - DNA, 20 bp, Artificial Sequence
  Description of Artificial Sequence: Synthetic oligonucleotide
  Target: AGXT; (+) strand; PAM type: YTN; PAM sequence: CTG
gggtgaggacagctttgtca

SEQ ID NO: 16996 - DNA, 20 bp, Artificial Sequence
  Description of Artificial Sequence: Synthetic oligonucleotide
  Target: AGXT; (+) strand; PAM type: YTN; PAM sequence: CTT
tgtcacactctgtttttctg

SEQ ID NO: 16997 - DNA, 20 bp, Artificial Sequence
  Description of Artificial Sequence: Synthetic oligonucleotide
  Target: AGXT; (+) strand; PAM type: YTN; PAM sequence: TTT
gtcacactctgtttttctgt

SEQ ID NO: 16998 - DNA, 20 bp, Artificial Sequence
  Description of Artificial Sequence: Synthetic oligonucleotide
  Target: AGXT; (+) strand; PAM type: YTN; PAM sequence: TTG
tcacactctgtttttctgtc

SEQ ID NO: 16999 - DNA, 20 bp, Artificial Sequence
  Description of Artificial Sequence: Synthetic oligonucleotide
  Target: AGXT; (+) strand; PAM type: YTN; PAM sequence: CTC
tgtttttctgtcactcagcc

SEQ ID NO: 17000 - DNA, 20 bp, Artificial Sequence
  Description of Artificial Sequence: Synthetic oligonucleotide
  Target: AGXT; (+) strand; PAM type: YTN; PAM sequence: CTG
tttttctgtcactcagccct

SEQ ID NO: 17001 - DNA, 20 bp, Artificial Sequence
  Description of Artificial Sequence: Synthetic oligonucleotide
  Target: AGXT; (+) strand; PAM type: YTN; PAM sequence: TTT
ttctgtcactcagccctggg

SEQ ID NO: 17002 - DNA, 20 bp, Artificial Sequence
  Description of Artificial Sequence: Synthetic oligonucleotide
  Target: AGXT; (+) strand; PAM type: YTN; PAM sequence: TTT
tctgtcactcagccctgggg

SEQ ID NO: 17003 - DNA, 20 bp, Artificial Sequence
  Description of Artificial Sequence: Synthetic oligonucleotide
  Target: AGXT; (+) strand; PAM type: YTN; PAM sequence: TTT
ctgtcactcagccctggggg

SEQ ID NO: 17004 - DNA, 20 bp, Artificial Sequence
  Description of Artificial Sequence: Synthetic oligonucleotide
  Target: AGXT; (+) strand; PAM type: YTN; PAM sequence: TTC
tgtcactcagccctgggggc

SEQ ID NO: 17005 - DNA, 20 bp, Artificial Sequence
  Description of Artificial Sequence: Synthetic oligonucleotide
  Target: AGXT; (+) strand; PAM type: YTN; PAM sequence: CTG
tcactcagccctgggggctc

SEQ ID NO: 17006 - DNA, 20 bp, Artificial Sequence
  Description of Artificial Sequence: Synthetic oligonucleotide
  Target: AGXT; (+) strand; PAM type: YTN; PAM sequence: CTC
agccctgggggctccctctg

SEQ ID NO: 17007 - DNA, 20 bp, Artificial Sequence
  Description of Artificial Sequence: Synthetic oligonucleotide
  Target: AGXT; (+) strand; PAM type: YTN; PAM sequence: CTG
ggggctccctctgcctgagg

SEQ ID NO: 17008 - DNA, 20 bp, Artificial Sequence
  Description of Artificial Sequence: Synthetic oligonucleotide
  Target: AGXT; (+) strand; PAM type: YTN; PAM sequence: CTC
cctctgcctgagggcttcgt

SEQ ID NO: 17009 - DNA, 20 bp, Artificial Sequence
  Description of Artificial Sequence: Synthetic oligonucleotide
  Target: AGXT; (+) strand; PAM type: YTN; PAM sequence: CTC
tgcctgagggcttcgtcccc

SEQ ID NO: 17010 - DNA, 20 bp, Artificial Sequence
  Description of Artificial Sequence: Synthetic oligonucleotide
  Target: AGXT; (+) strand; PAM type: YTN; PAM sequence: CTG
cctgagggcttcgtcccctg

SEQ ID NO: 17011 - DNA, 20 bp, Artificial Sequence
  Description of Artificial Sequence: Synthetic oligonucleotide
  Target: AGXT; (+) strand; PAM type: YTN; PAM sequence: CTG
agggcttcgtcccctgctgc

SEQ ID NO: 17012 - DNA, 20 bp, Artificial Sequence
  Description of Artificial Sequence: Synthetic oligonucleotide
  Target: AGXT; (+) strand; PAM type: YTN; PAM sequence: CTT
cgtcccctgctgcctggccg

SEQ ID NO: 17013 - DNA, 20 bp, Artificial Sequence
  Description of Artificial Sequence: Synthetic oligonucleotide
  Target: AGXT; (+) strand; PAM type: YTN; PAM sequence: TTC
gtcccctgctgcctggccgt

SEQ ID NO: 17014 - DNA, 20 bp, Artificial Sequence
  Description of Artificial Sequence: Synthetic oligonucleotide
  Target: AGXT; (+) strand; PAM type: YTN; PAM sequence: CTG
ctgcctggccgtgacccgca

SEQ ID NO: 17015 - DNA, 20 bp, Artificial Sequence
  Description of Artificial Sequence: Synthetic oligonucleotide
  Target: AGXT; (+) strand; PAM type: YTN; PAM sequence: CTG
cctggccgtgacccgcagca

SEQ ID NO: 17016 - DNA, 20 bp, Artificial Sequence
  Description of Artificial Sequence: Synthetic oligonucleotide
  Target: AGXT; (+) strand; PAM type: YTN; PAM sequence: CTG
gccgtgacccgcagcacaag

SEQ ID NO: 17017 - DNA, 20 bp, Artificial Sequence
  Description of Artificial Sequence: Synthetic oligonucleotide
  Target: AGXT; (+) strand; PAM type: YTN; PAM sequence: CTC
agggaacaaaaggcagggct

SEQ ID NO: 17018 - DNA, 20 bp, Artificial Sequence
  Description of Artificial Sequence: Synthetic oligonucleotide
  Target: AGXT; (+) strand; PAM type: YTN; PAM sequence: CTG
ccacggaagcccatccacca

SEQ ID NO: 17019 - DNA, 20 bp, Artificial Sequence
  Description of Artificial Sequence: Synthetic oligonucleotide
  Target: AGXT; (+) strand; PAM type: YTN; PAM sequence: CTC
acctctcacctctgtgtccg

SEQ ID NO: 17020 - DNA, 20 bp, Artificial Sequence
  Description of Artificial Sequence: Synthetic oligonucleotide
  Target: AGXT; (+) strand; PAM type: YTN; PAM sequence: CTC
tcacctctgtgtccgccctg

SEQ ID NO: 17021 - DNA, 20 bp, Artificial Sequence
  Description of Artificial Sequence: Synthetic oligonucleotide
  Target: AGXT; (+) strand; PAM type: YTN; PAM sequence: CTC
acctctgtgtccgccctgct

SEQ ID NO: 17022 - DNA, 20 bp, Artificial Sequence
  Description of Artificial Sequence: Synthetic oligonucleotide
  Target: AGXT; (+) strand; PAM type: YTN; PAM sequence: CTC
tgtgtccgccctgctgggaa

SEQ ID NO: 17023 - DNA, 20 bp, Artificial Sequence
  Description of Artificial Sequence: Synthetic oligonucleotide
  Target: AGXT; (+) strand; PAM type: YTN; PAM sequence: CTG
tgtccgccctgctgggaaat

SEQ ID NO: 17024 - DNA, 20 bp, Artificial Sequence
  Description of Artificial Sequence: Synthetic oligonucleotide
  Target: AGXT; (+) strand; PAM type: YTN; PAM sequence: CTG
ctgggaaatattccaggctt

SEQ ID NO: 17025 - DNA, 20 bp, Artificial Sequence
  Description of Artificial Sequence: Synthetic oligonucleotide
  Target: AGXT; (+) strand; PAM type: YTN; PAM sequence: CTG
ggaaatattccaggctttgg

SEQ ID NO: 17026 - DNA, 20 bp, Artificial Sequence
  Description of Artificial Sequence: Synthetic oligonucleotide
  Target: AGXT; (+) strand; PAM type: YTN; PAM sequence: TTC
caggctttggccaaggccag

SEQ ID NO: 17027 - DNA, 20 bp, Artificial Sequence
  Description of Artificial Sequence: Synthetic oligonucleotide
  Target: AGXT; (+) strand; PAM type: YTN; PAM sequence: CTT
tggccaaggccagtgcagcc

SEQ ID NO: 17028 - DNA, 20 bp, Artificial Sequence
  Description of Artificial Sequence: Synthetic oligonucleotide
  Target: AGXT; (+) strand; PAM type: YTN; PAM sequence: TTT
ggccaaggccagtgcagccc

SEQ ID NO: 17029 - DNA, 20 bp, Artificial Sequence
  Description of Artificial Sequence: Synthetic oligonucleotide
  Target: AGXT; (+) strand; PAM type: YTN; PAM sequence: TTG
gccaaggccagtgcagcccc

SEQ ID NO: 17030 - DNA, 20 bp, Artificial Sequence
  Description of Artificial Sequence: Synthetic oligonucleotide
  Target: AGXT; (+) strand; PAM type: YTN; PAM sequence: TTC
ccgagcggcaggttgggtgc

SEQ ID NO: 17031 - DNA, 20 bp, Artificial Sequence
  Description of Artificial Sequence: Synthetic oligonucleotide
  Target: AGXT; (+) strand; PAM type: YTN; PAM sequence: TTG
ggtgcggaccatggcctctc

SEQ ID NO: 17032 - DNA, 20 bp, Artificial Sequence
  Description of Artificial Sequence: Synthetic oligonucleotide
  Target: AGXT; (+) strand; PAM type: YTN; PAM sequence: CTC
tcacaagctgctggtgaccc

SEQ ID NO: 17033 - DNA, 20 bp, Artificial Sequence
  Description of Artificial Sequence: Synthetic oligonucleotide
  Target: AGXT; (+) strand; PAM type: YTN; PAM sequence: CTC
acaagctgctggtgaccccc

SEQ ID NO: 17034 - DNA, 20 bp, Artificial Sequence
  Description of Artificial Sequence: Synthetic oligonucleotide
  Target: AGXT; (+) strand; PAM type: YTN; PAM sequence: CTG
ctggtgaccccccccaaggc

SEQ ID NO: 17035 - DNA, 20 bp, Artificial Sequence
  Description of Artificial Sequence: Synthetic oligonucleotide
  Target: AGXT; (+) strand; PAM type: YTN; PAM sequence: CTG
gtgaccccccccaaggccct

SEQ ID NO: 17036 - DNA, 20 bp, Artificial Sequence
  Description of Artificial Sequence: Synthetic oligonucleotide
  Target: AGXT; (+) strand; PAM type: YTN; PAM sequence: CTG
ctcaagcccctctccatccc

SEQ ID NO: 17037 - DNA, 20 bp, Artificial Sequence
  Description of Artificial Sequence: Synthetic oligonucleotide
  Target: AGXT; (+) strand; PAM type: YTN; PAM sequence: CTC
aagcccctctccatccccaa

SEQ ID NO: 17038 - DNA, 20 bp, Artificial Sequence
  Description of Artificial Sequence: Synthetic oligonucleotide
  Target: AGXT; (+) strand; PAM type: YTN; PAM sequence: CTC
tccatccccaaccagctcct

SEQ ID NO: 17039 - DNA, 20 bp, Artificial Sequence
  Description of Artificial Sequence: Synthetic oligonucleotide
  Target: AGXT; (+) strand; PAM type: YTN; PAM sequence: CTC
catccccaaccagctcctgc

SEQ ID NO: 17040 - DNA, 20 bp, Artificial Sequence
  Description of Artificial Sequence: Synthetic oligonucleotide
  Target: AGXT; (+) strand; PAM type: YTN; PAM sequence: CTC
ctgctggggcctggtccttc

SEQ ID NO: 17041 - DNA, 20 bp, Artificial Sequence
  Description of Artificial Sequence: Synthetic oligonucleotide
  Target: AGXT; (+) strand; PAM type: YTN; PAM sequence: CTG
ctggggcctggtccttccaa

SEQ ID NO: 17042 - DNA, 20 bp, Artificial Sequence
  Description of Artificial Sequence: Synthetic oligonucleotide
  Target: AGXT; (+) strand; PAM type: YTN; PAM sequence: CTG
gggcctggtccttccaacct

SEQ ID NO: 17043 - DNA, 20 bp, Artificial Sequence
  Description of Artificial Sequence: Synthetic oligonucleotide
  Target: AGXT; (+) strand; PAM type: YTN; PAM sequence: CTG
gtccttccaacctgcctcct

SEQ ID NO: 17044 - DNA, 20 bp, Artificial Sequence
  Description of Artificial Sequence: Synthetic oligonucleotide
  Target: AGXT; (+) strand; PAM type: YTN; PAM sequence: CTT
ccaacctgcctcctcgcatc

SEQ ID NO: 17045 - DNA, 20 bp, Artificial Sequence
  Description of Artificial Sequence: Synthetic oligonucleotide
  Target: AGXT; (+) strand; PAM type: YTN; PAM sequence: TTC
caacctgcctcctcgcatca

SEQ ID NO: 17046 - DNA, 20 bp, Artificial Sequence
  Description of Artificial Sequence: Synthetic oligonucleotide
  Target: AGXT; (+) strand; PAM type: YTN; PAM sequence: CTG
cctcctcgcatcatggcagc

SEQ ID NO: 17047 - DNA, 20 bp, Artificial Sequence
  Description of Artificial Sequence: Synthetic oligonucleotide
  Target: AGXT; (+) strand; PAM type: YTN; PAM sequence: CTC
ctcgcatcatggcagccggg

SEQ ID NO: 17048 - DNA, 20 bp, Artificial Sequence
  Description of Artificial Sequence: Synthetic oligonucleotide
  Target: AGXT; (+) strand; PAM type: YTN; PAM sequence: CTC
gcatcatggcagccgggggg

SEQ ID NO: 17049 - DNA, 20 bp, Artificial Sequence
  Description of Artificial Sequence: Synthetic oligonucleotide
  Target: AGXT; (+) strand; PAM type: YTN; PAM sequence: CTG
cagatgatcgggtccatgag

SEQ ID NO: 17050 - DNA, 20 bp, Artificial Sequence
  Description of Artificial Sequence: Synthetic oligonucleotide
  Target: AGXT; (+) strand; PAM type: YTN; PAM sequence: CTC
ggggggcctgggtctcaccc

SEQ ID NO: 17051 - DNA, 20 bp, Artificial Sequence
  Description of Artificial Sequence: Synthetic oligonucleotide
  Target: AGXT; (+) strand; PAM type: YTN; PAM sequence: CTG
ggtctcacccatgttcccac

SEQ ID NO: 17052 - DNA, 20 bp, Artificial Sequence
  Description of Artificial Sequence: Synthetic oligonucleotide
  Target: AGXT; (+) strand; PAM type: YTN; PAM sequence: CTC
acccatgttcccacccacag

SEQ ID NO: 17053 - DNA, 20 bp, Artificial Sequence
  Description of Artificial Sequence: Synthetic oligonucleotide
  Target: AGXT; (+) strand; PAM type: YTN; PAM sequence: TTC
ccacccacagatcgtggacg

SEQ ID NO: 17054 - DNA, 20 bp, Artificial Sequence
  Description of Artificial Sequence: Synthetic oligonucleotide
  Target: AGXT; (+) strand; PAM type: YTN; PAM sequence: CTG
cctcctcacttggggaggcg

SEQ ID NO: 17055 - DNA, 20 bp, Artificial Sequence
  Description of Artificial Sequence: Synthetic oligonucleotide
  Target: AGXT; (+) strand; PAM type: YTN; PAM sequence: CTC
ctcacttggggaggcgggga

SEQ ID NO: 17056 - DNA, 20 bp, Artificial Sequence
  Description of Artificial Sequence: Synthetic oligonucleotide
  Target: AGXT; (+) strand; PAM type: YTN; PAM sequence: CTC
acttggggaggcggggagcc

SEQ ID NO: 17057 - DNA, 20 bp, Artificial Sequence
  Description of Artificial Sequence: Synthetic oligonucleotide
  Target: AGXT; (+) strand; PAM type: YTN; PAM sequence: CTT
ggggaggcggggagcctggg

SEQ ID NO: 17058 - DNA, 20 bp, Artificial Sequence
  Description of Artificial Sequence: Synthetic oligonucleotide
  Target: AGXT; (+) strand; PAM type: YTN; PAM sequence: TTG
gggaggcggggagcctgggt

SEQ ID NO: 17059 - DNA, 20 bp, Artificial Sequence
  Description of Artificial Sequence: Synthetic oligonucleotide
  Target: AGXT; (+) strand; PAM type: YTN; PAM sequence: CTG
ggtctcaccctataccaccc

SEQ ID NO: 17060 - DNA, 20 bp, Artificial Sequence
  Description of Artificial Sequence: Synthetic oligonucleotide
  Target: AGXT; (+) strand; PAM type: YTN; PAM sequence: CTC
accctataccacccgcatgc

SEQ ID NO: 17061 - DNA, 20 bp, Artificial Sequence
  Description of Artificial Sequence: Synthetic oligonucleotide
  Target: AGXT; (+) strand; PAM type: YTN; PAM sequence: CTA
taccacccgcatgcagatca

SEQ ID NO: 17062 - DNA, 20 bp, Artificial Sequence
  Description of Artificial Sequence: Synthetic oligonucleotide
  Target: AGXT; (+) strand; PAM type: YTN; PAM sequence: TTC
cagaccaggaacccactcac

SEQ ID NO: 17063 - DNA, 20 bp, Artificial Sequence
  Description of Artificial Sequence: Synthetic oligonucleotide
  Target: AGXT; (+) strand; PAM type: YTN; PAM sequence: CTC
acactggtcatctctggctc

SEQ ID NO: 17064 - DNA, 20 bp, Artificial Sequence
  Description of Artificial Sequence: Synthetic oligonucleotide
  Target: AGXT; (+) strand; PAM type: YTN; PAM sequence: CTG
gtcatctctggctcgggaca

SEQ ID NO: 17065 - DNA, 20 bp, Artificial Sequence
  Description of Artificial Sequence: Synthetic oligonucleotide
  Target: AGXT; (+) strand; PAM type: YTN; PAM sequence: CTC
tggctcgggacactgtgccc

SEQ ID NO: 17066 - DNA, 20 bp, Artificial Sequence
  Description of Artificial Sequence: Synthetic oligonucleotide
  Target: AGXT; (+) strand; PAM type: YTN; PAM sequence: CTG
gctcgggacactgtgccctg

SEQ ID NO: 17067 - DNA, 20 bp, Artificial Sequence
  Description of Artificial Sequence: Synthetic oligonucleotide
  Target: AGXT; (+) strand; PAM type: YTN; PAM sequence: CTC
gggacactgtgccctggagg

SEQ ID NO: 17068 - DNA, 20 bp, Artificial Sequence
  Description of Artificial Sequence: Synthetic oligonucleotide
  Target: AGXT; (+) strand; PAM type: YTN; PAM sequence: CTG
tgccctggaggccgccctgg

SEQ ID NO: 17069 - DNA, 20 bp, Artificial Sequence
  Description of Artificial Sequence: Synthetic oligonucleotide
  Target: AGXT; (+) strand; PAM type: YTN; PAM sequence: CTG
gaggccgccctggtcaatgt

SEQ ID NO: 17070 - DNA, 20 bp, Artificial Sequence
  Description of Artificial Sequence: Synthetic oligonucleotide
  Target: AGXT; (+) strand; PAM type: YTN; PAM sequence: CTG
gtcaatgtgctggagcctgg

SEQ ID NO: 17071 - DNA, 20 bp, Artificial Sequence
  Description of Artificial Sequence: Synthetic oligonucleotide
  Target: AGXT; (+) strand; PAM type: YTN; PAM sequence: CTG
gagcctggggactccttcct

SEQ ID NO: 17072 - DNA, 20 bp, Artificial Sequence
  Description of Artificial Sequence: Synthetic oligonucleotide
  Target: AGXT; (+) strand; PAM type: YTN; PAM sequence: CTG
gggactccttcctggttggg

SEQ ID NO: 17073 - DNA, 20 bp, Artificial Sequence
  Description of Artificial Sequence: Synthetic oligonucleotide
  Target: AGXT; (+) strand; PAM type: YTN; PAM sequence: CTC
cttcctggttggggccaatg

SEQ ID NO: 17074 - DNA, 20 bp, Artificial Sequence
  Description of Artificial Sequence: Synthetic oligonucleotide
  Target: AGXT; (+) strand; PAM type: YTN; PAM sequence: CTT
cctggttggggccaatggca

SEQ ID NO: 17075 - DNA, 20 bp, Artificial Sequence
  Description of Artificial Sequence: Synthetic oligonucleotide
  Target: AGXT; (+) strand; PAM type: YTN; PAM sequence: TTC
ctggttggggccaatggcat

SEQ ID NO: 17076 - DNA, 20 bp, Artificial Sequence
  Description of Artificial Sequence: Synthetic oligonucleotide
  Target: AGXT; (+) strand; PAM type: YTN; PAM sequence: CTG
gttggggccaatggcatttg

SEQ ID NO: 17077 - DNA, 20 bp, Artificial Sequence
  Description of Artificial Sequence: Synthetic oligonucleotide
  Target: AGXT; (+) strand; PAM type: YTN; PAM sequence: TTG
gggccaatggcatttggggg

SEQ ID NO: 17078 - DNA, 20 bp, Artificial Sequence
  Description of Artificial Sequence: Synthetic oligonucleotide
  Target: AGXT; (+) strand; PAM type: YTN; PAM sequence: TTT
gggggcagcgagccgtggac

SEQ ID NO: 17079 - DNA, 20 bp, Artificial Sequence
  Description of Artificial Sequence: Synthetic oligonucleotide
  Target: AGXT; (+) strand; PAM type: YTN; PAM sequence: TTG
ggggcagcgagccgtggaca

SEQ ID NO: 17080 - DNA, 20 bp, Artificial Sequence
  Description of Artificial Sequence: Synthetic oligonucleotide
  Target: AGXT; (+) strand; PAM type: YTN; PAM sequence: CTG
gatccatccttcaaggcctc

SEQ ID NO: 17081 - DNA, 20 bp, Artificial Sequence
  Description of Artificial Sequence: Synthetic oligonucleotide
  Target: AGXT; (+) strand; PAM type: YTN; PAM sequence: CTT
caaggcctccctggcctccc

SEQ ID NO: 17082 - DNA, 20 bp, Artificial Sequence
  Description of Artificial Sequence: Synthetic oligonucleotide
  Target: AGXT; (+) strand; PAM type: YTN; PAM sequence: TTC
aaggcctccctggcctccct

SEQ ID NO: 17083 - DNA, 20 bp, Artificial Sequence
  Description of Artificial Sequence: Synthetic oligonucleotide
  Target: AGXT; (+) strand; PAM type: YTN; PAM sequence: CTC
cctggcctccctctgtttga

SEQ ID NO: 17084 - DNA, 20 bp, Artificial Sequence
  Description of Artificial Sequence: Synthetic oligonucleotide
  Target: AGXT; (+) strand; PAM type: YTN; PAM sequence: CTG
gcctccctctgtttgaagct

SEQ ID NO: 17085 - DNA, 20 bp, Artificial Sequence
  Description of Artificial Sequence: Synthetic oligonucleotide
  Target: AGXT; (+) strand; PAM type: YTN; PAM sequence: CTC
cctctgtttgaagctggcag

SEQ ID NO: 17086 - DNA, 20 bp, Artificial Sequence
  Description of Artificial Sequence: Synthetic oligonucleotide
  Target: AGXT; (+) strand; PAM type: YTN; PAM sequence: CTC
tgtttgaagctggcagcccc

SEQ ID NO: 17087 - DNA, 20 bp, Artificial Sequence
  Description of Artificial Sequence: Synthetic oligonucleotide
  Target: AGXT; (+) strand; PAM type: YTN; PAM sequence: CTG
tttgaagctggcagcccccg

SEQ ID NO: 17088 - DNA, 20 bp, Artificial Sequence
  Description of Artificial Sequence: Synthetic oligonucleotide
  Target: AGXT; (+) strand; PAM type: YTN; PAM sequence: TTT
gaagctggcagcccccgttc

SEQ ID NO: 17089 - DNA, 20 bp, Artificial Sequence
  Description of Artificial Sequence: Synthetic oligonucleotide
  Target: AGXT; (+) strand; PAM type: YTN; PAM sequence: TTG
aagctggcagcccccgttcc

SEQ ID NO: 17090 - DNA, 20 bp, Artificial Sequence
  Description of Artificial Sequence: Synthetic oligonucleotide
  Target: AGXT; (+) strand; PAM type: YTN; PAM sequence: CTG
gcagcccccgttcctgggtg

SEQ ID NO: 17091 - DNA, 20 bp, Artificial Sequence
  Description of Artificial Sequence: Synthetic oligonucleotide
  Target: AGXT; (+) strand; PAM type: YTN; PAM sequence: TTC
ctgggtgagcgcttacccac

SEQ ID NO: 17092 - DNA, 20 bp, Artificial Sequence
  Description of Artificial Sequence: Synthetic oligonucleotide
  Target: AGXT; (+) strand; PAM type: YTN; PAM sequence: CTG
ggtgagcgcttacccacctt

SEQ ID NO: 17093 - DNA, 20 bp, Artificial Sequence
  Description of Artificial Sequence: Synthetic oligonucleotide
  Target: AGXT; (+) strand; PAM type: YTN; PAM sequence: CTT
acccaccttgtggccctgtg

SEQ ID NO: 17094 - DNA, 20 bp, Artificial Sequence
  Description of Artificial Sequence: Synthetic oligonucleotide
  Target: AGXT; (+) strand; PAM type: YTN; PAM sequence: TTA
cccaccttgtggccctgtgc

SEQ ID NO: 17095 - DNA, 20 bp, Artificial Sequence
  Description of Artificial Sequence: Synthetic oligonucleotide
  Target: AGXT; (+) strand; PAM type: YTN; PAM sequence: CTT
gtggccctgtgcgcacgaac

SEQ ID NO: 17096 - DNA, 20 bp, Artificial Sequence
  Description of Artificial Sequence: Synthetic oligonucleotide
  Target: AGXT; (+) strand; PAM type: YTN; PAM sequence: TTG
tggccctgtgcgcacgaacc

SEQ ID NO: 17097 - DNA, 20 bp, Artificial Sequence
  Description of Artificial Sequence: Synthetic oligonucleotide
  Target: AGXT; (+) strand; PAM type: YTN; PAM sequence: CTG
tgcgcacgaacctcctgcca

SEQ ID NO: 17098 - DNA, 20 bp, Artificial Sequence
  Description of Artificial Sequence: Synthetic oligonucleotide
  Target: AGXT; (+) strand; PAM type: YTN; PAM sequence: CTC
ctgccagcccactgcctcct

SEQ ID NO: 17099 - DNA, 20 bp, Artificial Sequence
  Description of Artificial Sequence: Synthetic oligonucleotide
  Target: AGXT; (+) strand; PAM type: YTN; PAM sequence: CTG
ccagcccactgcctcctcca

SEQ ID NO: 17100 - DNA, 20 bp, Artificial Sequence
  Description of Artificial Sequence: Synthetic oligonucleotide
  Target: AGXT; (+) strand; PAM type: YTN; PAM sequence: CTG
cctcctccaggcggtgtcgg

SEQ ID NO: 17101 - DNA, 20 bp, Artificial Sequence
  Description of Artificial Sequence: Synthetic oligonucleotide
  Target: AGXT; (+) strand; PAM type: YTN; PAM sequence: CTC
ctccaggcggtgtcgggcac

SEQ ID NO: 17102 - DNA, 20 bp, Artificial Sequence
  Description of Artificial Sequence: Synthetic oligonucleotide
  Target: AGXT; (+) strand; PAM type: YTN; PAM sequence: CTC
caggcggtgtcgggcactca

SEQ ID NO: 17103 - DNA, 20 bp, Artificial Sequence
  Description of Artificial Sequence: Synthetic oligonucleotide
  Target: AGXT; (+) strand; PAM type: YTN; PAM sequence: CTC
atgaggcctgactctgatag

SEQ ID NO: 17104 - DNA, 20 bp, Artificial Sequence
  Description of Artificial Sequence: Synthetic oligonucleotide
  Target: AGXT; (+) strand; PAM type: YTN; PAM sequence: CTG
actctgatagggctgggagc

SEQ ID NO: 17105 - DNA, 20 bp, Artificial Sequence
  Description of Artificial Sequence: Synthetic oligonucleotide
  Target: AGXT; (+) strand; PAM type: YTN; PAM sequence: CTC
tgatagggctgggagcagca

SEQ ID NO: 17106 - DNA, 20 bp, Artificial Sequence
  Description of Artificial Sequence: Synthetic oligonucleotide
  Target: AGXT; (+) strand; PAM type: YTN; PAM sequence: CTG
atagggctgggagcagcaca

SEQ ID NO: 17107 - DNA, 20 bp, Artificial Sequence
  Description of Artificial Sequence: Synthetic oligonucleotide
  Target: AGXT; (+) strand; PAM type: YTN; PAM sequence: CTG
ggagcagcacaggtgccccg

SEQ ID NO: 17108 - DNA, 20 bp, Artificial Sequence
  Description of Artificial Sequence: Synthetic oligonucleotide
  Target: AGXT; (+) strand; PAM type: YTN; PAM sequence: CTC
cttgagctgtttctggagca

SEQ ID NO: 17109 - DNA, 20 bp, Artificial Sequence
  Description of Artificial Sequence: Synthetic oligonucleotide
  Target: AGXT; (+) strand; PAM type: YTN; PAM sequence: CTT
gagctgtttctggagcatgt

SEQ ID NO: 17110 - DNA, 20 bp, Artificial Sequence
  Description of Artificial Sequence: Synthetic oligonucleotide
  Target: AGXT; (+) strand; PAM type: YTN; PAM sequence: TTG
agctgtttctggagcatgtg

SEQ ID NO: 17111 - DNA, 20 bp, Artificial Sequence
  Description of Artificial Sequence: Synthetic oligonucleotide
  Target: AGXT; (+) strand; PAM type: YTN; PAM sequence: CTG
tttctggagcatgtgcagga

SEQ ID NO: 17112 - DNA, 20 bp, Artificial Sequence
  Description of Artificial Sequence: Synthetic oligonucleotide
  Target: AGXT; (+) strand; PAM type: YTN; PAM sequence: TTT
ctggagcatgtgcaggacgg

SEQ ID NO: 17113 - DNA, 20 bp, Artificial Sequence
  Description of Artificial Sequence: Synthetic oligonucleotide
  Target: AGXT; (+) strand; PAM type: YTN; PAM sequence: TTC
tggagcatgtgcaggacgga

SEQ ID NO: 17114 - DNA, 20 bp, Artificial Sequence
  Description of Artificial Sequence: Synthetic oligonucleotide
  Target: AGXT; (+) strand; PAM type: YTN; PAM sequence: CTG
gagcatgtgcaggacggaac

SEQ ID NO: 17115 - DNA, 20 bp, Artificial Sequence
  Description of Artificial Sequence: Synthetic oligonucleotide
  Target: AGXT; (+) strand; PAM type: YTN; PAM sequence: CTA
cagggaagcctctggtccca

SEQ ID NO: 17116 - DNA, 20 bp, Artificial Sequence
  Description of Artificial Sequence: Synthetic oligonucleotide
  Target: AGXT; (+) strand; PAM type: YTN; PAM sequence: CTC
tggtcccagcacacactcct

SEQ ID NO: 17117 - DNA, 20 bp, Artificial Sequence
  Description of Artificial Sequence: Synthetic oligonucleotide
  Target: AGXT; (+) strand; PAM type: YTN; PAM sequence: CTG
gtcccagcacacactcctga

SEQ ID NO: 17118 - DNA, 20 bp, Artificial Sequence
  Description of Artificial Sequence: Synthetic oligonucleotide
  Target: AGXT; (+) strand; PAM type: YTN; PAM sequence: CTC
ctgagagccccggccgctgt

SEQ ID NO: 17119 - DNA, 20 bp, Artificial Sequence
  Description of Artificial Sequence: Synthetic oligonucleotide
  Target: AGXT; (+) strand; PAM type: YTN; PAM sequence: CTG
agagccccggccgctgtcca

SEQ ID NO: 17120 - DNA, 20 bp, Artificial Sequence
  Description of Artificial Sequence: Synthetic oligonucleotide
  Target: AGXT; (+) strand; PAM type: YTN; PAM sequence: CTG
tccagggccccaggcaccag

SEQ ID NO: 17121 - DNA, 20 bp, Artificial Sequence
  Description of Artificial Sequence: Synthetic oligonucleotide
  Target: AGXT; (+) strand; PAM type: YTN; PAM sequence: CTC
tgctttgtgacagggtgggg

SEQ ID NO: 17122 - DNA, 20 bp, Artificial Sequence
  Description of Artificial Sequence: Synthetic oligonucleotide
  Target: AGXT; (+) strand; PAM type: YTN; PAM sequence: CTG
ctttgtgacagggtggggtt

SEQ ID NO: 17123 - DNA, 20 bp, Artificial Sequence
  Description of Artificial Sequence: Synthetic oligonucleotide
  Target: AGXT; (+) strand; PAM type: YTN; PAM sequence: CTT
tgtgacagggtggggtttca

SEQ ID NO: 17124 - DNA, 20 bp, Artificial Sequence
  Description of Artificial Sequence: Synthetic oligonucleotide
  Target: AGXT; (+) strand; PAM type: YTN; PAM sequence: TTT
gtgacagggtggggtttcag

SEQ ID NO: 17125 - DNA, 20 bp, Artificial Sequence
  Description of Artificial Sequence: Synthetic oligonucleotide
  Target: AGXT; (+) strand; PAM type: YTN; PAM sequence: TTG
tgacagggtggggtttcaga

SEQ ID NO: 17126 - DNA, 20 bp, Artificial Sequence
  Description of Artificial Sequence: Synthetic oligonucleotide
  Target: AGXT; (+) strand; PAM type: YTN; PAM sequence: TTT
cagaagctgaagcctcccct

SEQ ID NO: 17127 - DNA, 20 bp, Artificial Sequence
  Description of Artificial Sequence: Synthetic oligonucleotide
  Target: AGXT; (+) strand; PAM type: YTN; PAM sequence: TTC
agaagctgaagcctcccctc

SEQ ID NO: 17128 - DNA, 20 bp, Artificial Sequence
  Description of Artificial Sequence: Synthetic oligonucleotide
  Target: AGXT; (+) strand; PAM type: YTN; PAM sequence: CTG
aagcctcccctcaaatctca

SEQ ID NO: 17129 - DNA, 20 bp, Artificial Sequence
  Description of Artificial Sequence: Synthetic oligonucleotide
  Target: AGXT; (+) strand; PAM type: YTN; PAM sequence: CTC
ccctcaaatctcagcagcct

SEQ ID NO: 17130 - DNA, 20 bp, Artificial Sequence
  Description of Artificial Sequence: Synthetic oligonucleotide
  Target: AGXT; (+) strand; PAM type: YTN; PAM sequence: CTC
aaatctcagcagccttcctt

SEQ ID NO: 17131 - DNA, 20 bp, Artificial Sequence
  Description of Artificial Sequence: Synthetic oligonucleotide
  Target: AGXT; (+) strand; PAM type: YTN; PAM sequence: CTC
agcagccttccttctggaat

SEQ ID NO: 17132 - DNA, 20 bp, Artificial Sequence
  Description of Artificial Sequence: Synthetic oligonucleotide
  Target: AGXT; (+) strand; PAM type: YTN; PAM sequence: CTT
ccttctggaatcttgatgtg

SEQ ID NO: 17133 - DNA, 20 bp, Artificial Sequence
  Description of Artificial Sequence: Synthetic oligonucleotide
  Target: AGXT; (+) strand; PAM type: YTN; PAM sequence: TTC
cttctggaatcttgatgtga

SEQ ID NO: 17134 - DNA, 20 bp, Artificial Sequence
  Description of Artificial Sequence: Synthetic oligonucleotide
  Target: AGXT; (+) strand; PAM type: YTN; PAM sequence: CTT
ctggaatcttgatgtgatac

SEQ ID NO: 17135 - DNA, 20 bp, Artificial Sequence
  Description of Artificial Sequence: Synthetic oligonucleotide
  Target: AGXT; (+) strand; PAM type: YTN; PAM sequence: TTC
tggaatcttgatgtgataca

SEQ ID NO: 17136 - DNA, 20 bp, Artificial Sequence
  Description of Artificial Sequence: Synthetic oligonucleotide
  Target: AGXT; (+) strand; PAM type: YTN; PAM sequence: CTG
gaatcttgatgtgatacaca

SEQ ID NO: 17137 - DNA, 20 bp, Artificial Sequence
  Description of Artificial Sequence: Synthetic oligonucleotide
  Target: AGXT; (+) strand; PAM type: YTN; PAM sequence: CTT
gatgtgatacacaaaatatg

SEQ ID NO: 17138 - DNA, 20 bp, Artificial Sequence
  Description of Artificial Sequence: Synthetic oligonucleotide
  Target: AGXT; (+) strand; PAM type: YTN; PAM sequence: TTG
atgtgatacacaaaatatgg

SEQ ID NO: 17139 - DNA, 20 bp, Artificial Sequence
  Description of Artificial Sequence: Synthetic oligonucleotide
  Target: AGXT; (+) strand; PAM type: YTN; PAM sequence: TTC
gcctccggagtacacttttc

SEQ ID NO: 17140 - DNA, 20 bp, Artificial Sequence
  Description of Artificial Sequence: Synthetic oligonucleotide
  Target: AGXT; (+) strand; PAM type: YTN; PAM sequence: CTC
cggagtacacttttctggga

SEQ ID NO: 17141 - DNA, 20 bp, Artificial Sequence
  Description of Artificial Sequence: Synthetic oligonucleotide
  Target: AGXT; (+) strand; PAM type: YTN; PAM sequence: CTT
ttctgggagagacacaggag

SEQ ID NO: 17142 - DNA, 20 bp, Artificial Sequence
  Description of Artificial Sequence: Synthetic oligonucleotide
  Target: AGXT; (+) strand; PAM type: YTN; PAM sequence: TTT
tctgggagagacacaggagc

SEQ ID NO: 17143 - DNA, 20 bp, Artificial Sequence
  Description of Artificial Sequence: Synthetic oligonucleotide
  Target: AGXT; (+) strand; PAM type: YTN; PAM sequence: TTT
ctgggagagacacaggagca

SEQ ID NO: 17144 - DNA, 20 bp, Artificial Sequence
  Description of Artificial Sequence: Synthetic oligonucleotide
  Target: AGXT; (+) strand; PAM type: YTN; PAM sequence: TTC
tgggagagacacaggagcag

SEQ ID NO: 17145 - DNA, 20 bp, Artificial Sequence
  Description of Artificial Sequence: Synthetic oligonucleotide
  Target: AGXT; (+) strand; PAM type: YTN; PAM sequence: CTG
ggagagacacaggagcagga

SEQ ID NO: 17146 - DNA, 20 bp, Artificial Sequence
  Description of Artificial Sequence: Synthetic oligonucleotide
  Target: AGXT; (+) strand; PAM type: YTN; PAM sequence: CTG
ggtttaatgattgattgtgg

SEQ ID NO: 17147 - DNA, 20 bp, Artificial Sequence
  Description of Artificial Sequence: Synthetic oligonucleotide
  Target: AGXT; (+) strand; PAM type: YTN; PAM sequence: TTT
aatgattgattgtggcattg

SEQ ID NO: 17148 - DNA, 20 bp, Artificial Sequence
  Description of Artificial Sequence: Synthetic oligonucleotide
  Target: AGXT; (+) strand; PAM type: YTN; PAM sequence: TTA
atgattgattgtggcattga

SEQ ID NO: 17149 - DNA, 20 bp, Artificial Sequence
  Description of Artificial Sequence: Synthetic oligonucleotide
  Target: AGXT; (+) strand; PAM type: YTN; PAM sequence: TTG
attgtggcattgagggacat

SEQ ID NO: 17150 - DNA, 20 bp, Artificial Sequence
  Description of Artificial Sequence: Synthetic oligonucleotide
  Target: AGXT; (+) strand; PAM type: YTN; PAM sequence: TTG
tggcattgagggacatcagc

SEQ ID NO: 17151 - DNA, 20 bp, Artificial Sequence
  Description of Artificial Sequence: Synthetic oligonucleotide
  Target: AGXT; (+) strand; PAM type: YTN; PAM sequence: TTG
agggacatcagcttggtgag

SEQ ID NO: 17152 - DNA, 20 bp, Artificial Sequence
  Description of Artificial Sequence: Synthetic oligonucleotide
  Target: AGXT; (+) strand; PAM type: YTN; PAM sequence: CTT
ggtgagctccacaatggcca

SEQ ID NO: 17153 - DNA, 20 bp, Artificial Sequence
  Description of Artificial Sequence: Synthetic oligonucleotide
  Target: AGXT; (+) strand; PAM type: YTN; PAM sequence: TTG
gtgagctccacaatggccat

SEQ ID NO: 17154 - DNA, 20 bp, Artificial Sequence
  Description of Artificial Sequence: Synthetic oligonucleotide
  Target: AGXT; (+) strand; PAM type: YTN; PAM sequence: CTC
cacaatggccatgctggtta

SEQ ID NO: 17155 - DNA, 20 bp, Artificial Sequence
  Description of Artificial Sequence: Synthetic oligonucleotide
  Target: AGXT; (+) strand; PAM type: YTN; PAM sequence: CTG
gttaatacgcgaccgcaaca

SEQ ID NO: 17156 - DNA, 20 bp, Artificial Sequence
  Description of Artificial Sequence: Synthetic oligonucleotide
  Target: AGXT; (+) strand; PAM type: YTN; PAM sequence: TTA
atacgcgaccgcaacagcca

SEQ ID NO: 17157 - DNA, 20 bp, Artificial Sequence
  Description of Artificial Sequence: Synthetic oligonucleotide
  Target: AGXT; (+) strand; PAM type: YTN; PAM sequence: CTT
ttcaaggggacccagggtcg

SEQ ID NO: 17158 - DNA, 20 bp, Artificial Sequence
  Description of Artificial Sequence: Synthetic oligonucleotide
  Target: AGXT; (+) strand; PAM type: YTN; PAM sequence: TTT
tcaaggggacccagggtcgg

SEQ ID NO: 17159 - DNA, 20 bp, Artificial Sequence
  Description of Artificial Sequence: Synthetic oligonucleotide
  Target: AGXT; (+) strand; PAM type: YTN; PAM sequence: TTT
caaggggacccagggtcggc

SEQ ID NO: 17160 - DNA, 20 bp, Artificial Sequence
  Description of Artificial Sequence: Synthetic oligonucleotide
  Target: AGXT; (+) strand; PAM type: YTN; PAM sequence: TTC
aaggggacccagggtcggca

SEQ ID NO: 17161 - DNA, 20 bp, Artificial Sequence
  Description of Artificial Sequence: Synthetic oligonucleotide
  Target: AGXT; (+) strand; PAM type: YTN; PAM sequence: CTC
agatgcctgtggtatatggc

SEQ ID NO: 17162 - DNA, 20 bp, Artificial Sequence
  Description of Artificial Sequence: Synthetic oligonucleotide
  Target: AGXT; (+) strand; PAM type: YTN; PAM sequence: CTG
tggtatatggcttccctttt

SEQ ID NO: 17163 - DNA, 20 bp, Artificial Sequence
  Description of Artificial Sequence: Synthetic oligonucleotide
  Target: AGXT; (+) strand; PAM type: YTN; PAM sequence: CTT
cccttttccccattctgtcc

SEQ ID NO: 17164 - DNA, 20 bp, Artificial Sequence
  Description of Artificial Sequence: Synthetic oligonucleotide
  Target: AGXT; (+) strand; PAM type: YTN; PAM sequence: TTC
ccttttccccattctgtccc

SEQ ID NO: 17165 - DNA, 20 bp, Artificial Sequence
  Description of Artificial Sequence: Synthetic oligonucleotide
  Target: AGXT; (+) strand; PAM type: YTN; PAM sequence: CTT
ttccccattctgtccccttg

SEQ ID NO: 17166 - DNA, 20 bp, Artificial Sequence
  Description of Artificial Sequence: Synthetic oligonucleotide
  Target: AGXT; (+) strand; PAM type: YTN; PAM sequence: TTT
tccccattctgtccccttgg

SEQ ID NO: 17167 - DNA, 20 bp, Artificial Sequence
  Description of Artificial Sequence: Synthetic oligonucleotide
  Target: AGXT; (+) strand; PAM type: YTN; PAM sequence: TTT
ccccattctgtccccttggc

SEQ ID NO: 17168 - DNA, 20 bp, Artificial Sequence
  Description of Artificial Sequence: Synthetic oligonucleotide
  Target: AGXT; (+) strand; PAM type: YTN; PAM sequence: TTC
cccattctgtccccttggcc

SEQ ID NO: 17169 - DNA, 20 bp, Artificial Sequence
  Description of Artificial Sequence: Synthetic oligonucleotide
  Target: AGXT; (+) strand; PAM type: YTN; PAM sequence: TTC
tgtccccttggccgcaggtt

SEQ ID NO: 17170 - DNA, 20 bp, Artificial Sequence
  Description of Artificial Sequence: Synthetic oligonucleotide
  Target: AGXT; (+) strand; PAM type: YTN; PAM sequence: CTG
tccccttggccgcaggttct

SEQ ID NO: 17171 - DNA, 20 bp, Artificial Sequence
  Description of Artificial Sequence: Synthetic oligonucleotide
  Target: AGXT; (+) strand; PAM type: YTN; PAM sequence: CTT
ggccgcaggttcttcccctc

SEQ ID NO: 17172 - DNA, 20 bp, Artificial Sequence
  Description of Artificial Sequence: Synthetic oligonucleotide
  Target: AGXT; (+) strand; PAM type: YTN; PAM sequence: TTG
gccgcaggttcttcccctcc

SEQ ID NO: 17173 - DNA, 20 bp, Artificial Sequence
  Description of Artificial Sequence: Synthetic oligonucleotide
  Target: AGXT; (+) strand; PAM type: YTN; PAM sequence: TTC
ttcccctcccacaacctggc

SEQ ID NO: 17174 - DNA, 20 bp, Artificial Sequence
  Description of Artificial Sequence: Synthetic oligonucleotide
  Target: AGXT; (+) strand; PAM type: YTN; PAM sequence: CTT
cccctcccacaacctggccc

SEQ ID NO: 17175 - DNA, 20 bp, Artificial Sequence
  Description of Artificial Sequence: Synthetic oligonucleotide
  Target: AGXT; (+) strand; PAM type: YTN; PAM sequence: TTC
ccctcccacaacctggccct

SEQ ID NO: 17176 - DNA, 20 bp, Artificial Sequence
  Description of Artificial Sequence: Synthetic oligonucleotide
  Target: AGXT; (+) strand; PAM type: YTN; PAM sequence: CTC
ccacaacctggccctgaaca

SEQ ID NO: 17177 - DNA, 20 bp, Artificial Sequence
  Description of Artificial Sequence: Synthetic oligonucleotide
  Target: AGXT; (+) strand; PAM type: YTN; PAM sequence: CTG
gccctgaacagcacacagga

SEQ ID NO: 17178 - DNA, 20 bp, Artificial Sequence
  Description of Artificial Sequence: Synthetic oligonucleotide
  Target: AGXT; (+) strand; PAM type: YTN; PAM sequence: CTG
aacagcacacaggatagggc

SEQ ID NO: 17179 - DNA, 20 bp, Artificial Sequence
  Description of Artificial Sequence: Synthetic oligonucleotide
  Target: AGXT; (+) strand; PAM type: YTN; PAM sequence: CTG
attcctggagtccccagctc

SEQ ID NO: 17180 - DNA, 20 bp, Artificial Sequence
  Description of Artificial Sequence: Synthetic oligonucleotide
  Target: AGXT; (+) strand; PAM type: YTN; PAM sequence: TTC
ctggagtccccagctccaac

SEQ ID NO: 17181 - DNA, 20 bp, Artificial Sequence
  Description of Artificial Sequence: Synthetic oligonucleotide
  Target: AGXT; (+) strand; PAM type: YTN; PAM sequence: CTG
gagtccccagctccaacaga

SEQ ID NO: 17182 - DNA, 20 bp, Artificial Sequence
  Description of Artificial Sequence: Synthetic oligonucleotide
  Target: AGXT; (+) strand; PAM type: YTN; PAM sequence: CTC
caacagaggtcaaggctgct

SEQ ID NO: 17183 - DNA, 20 bp, Artificial Sequence
  Description of Artificial Sequence: Synthetic oligonucleotide
  Target: AGXT; (+) strand; PAM type: YTN; PAM sequence: CTG
ctgcctcactcacccctcat

SEQ ID NO: 17184 - DNA, 20 bp, Artificial Sequence
  Description of Artificial Sequence: Synthetic oligonucleotide
  Target: AGXT; (+) strand; PAM type: YTN; PAM sequence: CTG
cctcactcacccctcatcct

SEQ ID NO: 17185 - DNA, 20 bp, Artificial Sequence
  Description of Artificial Sequence: Synthetic oligonucleotide
  Target: AGXT; (+) strand; PAM type: YTN; PAM sequence: CTC
actcacccctcatccttcag

SEQ ID NO: 17186 - DNA, 20 bp, Artificial Sequence
  Description of Artificial Sequence: Synthetic oligonucleotide
  Target: AGXT; (+) strand; PAM type: YTN; PAM sequence: CTC
acccctcatccttcagtctg

SEQ ID NO: 17187 - DNA, 20 bp, Artificial Sequence
  Description of Artificial Sequence: Synthetic oligonucleotide
  Target: AGXT; (+) strand; PAM type: YTN; PAM sequence: CTC
atccttcagtctgtcatcca

SEQ ID NO: 17188 - DNA, 20 bp, Artificial Sequence
  Description of Artificial Sequence: Synthetic oligonucleotide
  Target: AGXT; (+) strand; PAM type: YTN; PAM sequence: CTT
cagtctgtcatccatcacac

SEQ ID NO: 17189 - DNA, 20 bp, Artificial Sequence
  Description of Artificial Sequence: Synthetic oligonucleotide
  Target: AGXT; (+) strand; PAM type: YTN; PAM sequence: TTC
agtctgtcatccatcacacc

SEQ ID NO: 17190 - DNA, 20 bp, Artificial Sequence
  Description of Artificial Sequence: Synthetic oligonucleotide
  Target: AGXT; (+) strand; PAM type: YTN; PAM sequence: CTG
tcatccatcacacctgtggt

SEQ ID NO: 17191 - DNA, 20 bp, Artificial Sequence
  Description of Artificial Sequence: Synthetic oligonucleotide
  Target: AGXT; (+) strand; PAM type: YTN; PAM sequence: CTG
tggtgtgccagccctggacc

SEQ ID NO: 17192 - DNA, 20 bp, Artificial Sequence
  Description of Artificial Sequence: Synthetic oligonucleotide
  Target: AGXT; (+) strand; PAM type: YTN; PAM sequence: CTG
gaccaggtacactctttgtg

SEQ ID NO: 17193 - DNA, 20 bp, Artificial Sequence
  Description of Artificial Sequence: Synthetic oligonucleotide
  Target: AGXT; (+) strand; PAM type: YTN; PAM sequence: CTC
tttgtgccagccctgggcca

SEQ ID NO: 17194 - DNA, 20 bp, Artificial Sequence
  Description of Artificial Sequence: Synthetic oligonucleotide
  Target: AGXT; (+) strand; PAM type: YTN; PAM sequence: CTT
tgtgccagccctgggccagg

SEQ ID NO: 17195 - DNA, 20 bp, Artificial Sequence
  Description of Artificial Sequence: Synthetic oligonucleotide
  Target: AGXT; (+) strand; PAM type: YTN; PAM sequence: TTT
gtgccagccctgggccaggt

SEQ ID NO: 17196 - DNA, 20 bp, Artificial Sequence
  Description of Artificial Sequence: Synthetic oligonucleotide
  Target: AGXT; (+) strand; PAM type: YTN; PAM sequence: TTG
tgccagccctgggccaggtg

SEQ ID NO: 17197 - DNA, 20 bp, Artificial Sequence
  Description of Artificial Sequence: Synthetic oligonucleotide
  Target: AGXT; (+) strand; PAM type: YTN; PAM sequence: CTG
ggccaggtgcagccctgact

SEQ ID NO: 17198 - DNA, 20 bp, Artificial Sequence
  Description of Artificial Sequence: Synthetic oligonucleotide
  Target: AGXT; (+) strand; PAM type: YTN; PAM sequence: CTG
actcccgggagctcactctc

SEQ ID NO: 17199 - DNA, 20 bp, Artificial Sequence
  Description of Artificial Sequence: Synthetic oligonucleotide
  Target: AGXT; (+) strand; PAM type: YTN; PAM sequence: CTC
ccgggagctcactctctgct

SEQ ID NO: 17200 - DNA, 20 bp, Artificial Sequence
  Description of Artificial Sequence: Synthetic oligonucleotide
  Target: AGXT; (+) strand; PAM type: YTN; PAM sequence: CTC
actctctgcttggggaggca

SEQ ID NO: 17201 - DNA, 20 bp, Artificial Sequence
  Description of Artificial Sequence: Synthetic oligonucleotide
  Target: AGXT; (+) strand; PAM type: YTN; PAM sequence: CTC
tctgcttggggaggcactgg

SEQ ID NO: 17202 - DNA, 20 bp, Artificial Sequence
  Description of Artificial Sequence: Synthetic oligonucleotide
  Target: AGXT; (+) strand; PAM type: YTN; PAM sequence: CTC
tgcttggggaggcactggtc

SEQ ID NO: 17203 - DNA, 20 bp, Artificial Sequence
  Description of Artificial Sequence: Synthetic oligonucleotide
  Target: AGXT; (+) strand; PAM type: YTN; PAM sequence: CTG
cttggggaggcactggtcag

SEQ ID NO: 17204 - DNA, 20 bp, Artificial Sequence
  Description of Artificial Sequence: Synthetic oligonucleotide
  Target: AGXT; (+) strand; PAM type: YTN; PAM sequence: CTT
ggggaggcactggtcagtgt

SEQ ID NO: 17205 - DNA, 20 bp, Artificial Sequence
  Description of Artificial Sequence: Synthetic oligonucleotide
  Target: AGXT; (+) strand; PAM type: YTN; PAM sequence: TTG
gggaggcactggtcagtgtg

SEQ ID NO: 17206 - DNA, 20 bp, Artificial Sequence
  Description of Artificial Sequence: Synthetic oligonucleotide
  Target: AGXT; (+) strand; PAM type: YTN; PAM sequence: CTG
gtcagtgtggcctgagaaag

SEQ ID NO: 17207 - DNA, 20 bp, Artificial Sequence
  Description of Artificial Sequence: Synthetic oligonucleotide
  Target: AGXT; (+) strand; PAM type: YTN; PAM sequence: CTG
agaaagggcatttgagctga

SEQ ID NO: 17208 - DNA, 20 bp, Artificial Sequence
  Description of Artificial Sequence: Synthetic oligonucleotide
  Target: AGXT; (+) strand; PAM type: YTN; PAM sequence: TTT
gagctgagctctgtcaagag

SEQ ID NO: 17209 - DNA, 20 bp, Artificial Sequence
  Description of Artificial Sequence: Synthetic oligonucleotide
  Target: AGXT; (+) strand; PAM type: YTN; PAM sequence: TTG
agctgagctctgtcaagagt

SEQ ID NO: 17210 - DNA, 20 bp, Artificial Sequence
  Description of Artificial Sequence: Synthetic oligonucleotide
  Target: AGXT; (+) strand; PAM type: YTN; PAM sequence: CTG
agctctgtcaagagtgcccc

SEQ ID NO: 17211 - DNA, 20 bp, Artificial Sequence
  Description of Artificial Sequence: Synthetic oligonucleotide
  Target: AGXT; (+) strand; PAM type: YTN; PAM sequence: CTC
tgtcaagagtgccccaggag

SEQ ID NO: 17212 - DNA, 20 bp, Artificial Sequence
  Description of Artificial Sequence: Synthetic oligonucleotide
  Target: AGXT; (+) strand; PAM type: YTN; PAM sequence: CTG
tcaagagtgccccaggagcg

SEQ ID NO: 17213 - DNA, 20 bp, Artificial Sequence
  Description of Artificial Sequence: Synthetic oligonucleotide
  Target: AGXT; (+) strand; PAM type: YTN; PAM sequence: TTG
gctccaacagcaggggggtc

SEQ ID NO: 17214 - DNA, 20 bp, Artificial Sequence
  Description of Artificial Sequence: Synthetic oligonucleotide
  Target: AGXT; (+) strand; PAM type: YTN; PAM sequence: CTC
caacagcaggggggtcaaga

SEQ ID NO: 17215 - DNA, 20 bp, Artificial Sequence
  Description of Artificial Sequence: Synthetic oligonucleotide
  Target: AGXT; (+) strand; PAM type: YTN; PAM sequence: CTG
gctctacacacagagaggct

SEQ ID NO: 17216 - DNA, 20 bp, Artificial Sequence
  Description of Artificial Sequence: Synthetic oligonucleotide
  Target: AGXT; (+) strand; PAM type: YTN; PAM sequence: CTC
tacacacagagaggctctca

SEQ ID NO: 17217 - DNA, 20 bp, Artificial Sequence
  Description of Artificial Sequence: Synthetic oligonucleotide
  Target: AGXT; (+) strand; PAM type: YTN; PAM sequence: CTA
cacacagagaggctctcatt

SEQ ID NO: 17218 - DNA, 20 bp, Artificial Sequence
  Description of Artificial Sequence: Synthetic oligonucleotide
  Target: AGXT; (+) strand; PAM type: YTN; PAM sequence: CTC
tcattgggcagagtccaccc

SEQ ID NO: 17219 - DNA, 20 bp, Artificial Sequence
  Description of Artificial Sequence: Synthetic oligonucleotide
  Target: AGXT; (+) strand; PAM type: YTN; PAM sequence: CTC
attgggcagagtccaccctc

SEQ ID NO: 17220 - DNA, 20 bp, Artificial Sequence
  Description of Artificial Sequence: Synthetic oligonucleotide
  Target: AGXT; (+) strand; PAM type: YTN; PAM sequence: TTG
ggcagagtccaccctcctct

SEQ ID NO: 17221 - DNA, 20 bp, Artificial Sequence
  Description of Artificial Sequence: Synthetic oligonucleotide
  Target: AGXT; (+) strand; PAM type: YTN; PAM sequence: CTC
ctcttcaggcaggcagccag

SEQ ID NO: 17222 - DNA, 20 bp, Artificial Sequence
  Description of Artificial Sequence: Synthetic oligonucleotide
  Target: AGXT; (+) strand; PAM type: YTN; PAM sequence: CTC
ttcaggcaggcagccagggt

SEQ ID NO: 17223 - DNA, 20 bp, Artificial Sequence
  Description of Artificial Sequence: Synthetic oligonucleotide
  Target: AGXT; (+) strand; PAM type: YTN; PAM sequence: CTT
caggcaggcagccagggtgc

SEQ ID NO: 17224 - DNA, 20 bp, Artificial Sequence
  Description of Artificial Sequence: Synthetic oligonucleotide
  Target: AGXT; (+) strand; PAM type: YTN; PAM sequence: TTC
aggcaggcagccagggtgcc

SEQ ID NO: 17225 - DNA, 20 bp, Artificial Sequence
  Description of Artificial Sequence: Synthetic oligonucleotide
  Target: AGXT; (+) strand; PAM type: YTN; PAM sequence: CTC
acagggccctgctcagcagg

SEQ ID NO: 17226 - DNA, 20 bp, Artificial Sequence
  Description of Artificial Sequence: Synthetic oligonucleotide
  Target: AGXT; (+) strand; PAM type: YTN; PAM sequence: CTG
ctcagcagggccacgggtgc

SEQ ID NO: 17227 - DNA, 20 bp, Artificial Sequence
  Description of Artificial Sequence: Synthetic oligonucleotide
  Target: AGXT; (+) strand; PAM type: YTN; PAM sequence: CTC
agcagggccacgggtgccca

SEQ ID NO: 17228 - DNA, 20 bp, Artificial Sequence
  Description of Artificial Sequence: Synthetic oligonucleotide
  Target: AGXT; (+) strand; PAM type: YTN; PAM sequence: CTG
gcttctacagtgtgtgcggg

SEQ ID NO: 17229 - DNA, 20 bp, Artificial Sequence
  Description of Artificial Sequence: Synthetic oligonucleotide
  Target: AGXT; (+) strand; PAM type: YTN; PAM sequence: CTT
ctacagtgtgtgcgggacac

SEQ ID NO: 17230 - DNA, 20 bp, Artificial Sequence
  Description of Artificial Sequence: Synthetic oligonucleotide
  Target: AGXT; (+) strand; PAM type: YTN; PAM sequence: TTC
tacagtgtgtgcgggacact

SEQ ID NO: 17231 - DNA, 20 bp, Artificial Sequence
  Description of Artificial Sequence: Synthetic oligonucleotide
  Target: AGXT; (+) strand; PAM type: YTN; PAM sequence: CTA
cagtgtgtgcgggacactca

SEQ ID NO: 17232 - DNA, 20 bp, Artificial Sequence
  Description of Artificial Sequence: Synthetic oligonucleotide
  Target: AGXT; (+) strand; PAM type: YTN; PAM sequence: CTC
acggcccactctgtcctgca

SEQ ID NO: 17233 - DNA, 20 bp, Artificial Sequence
  Description of Artificial Sequence: Synthetic oligonucleotide
  Target: AGXT; (+) strand; PAM type: YTN; PAM sequence: CTC
tgtcctgcacccaggagccc

SEQ ID NO: 17234 - DNA, 20 bp, Artificial Sequence
  Description of Artificial Sequence: Synthetic oligonucleotide
  Target: AGXT; (+) strand; PAM type: YTN; PAM sequence: CTG
tcctgcacccaggagcccga

SEQ ID NO: 17235 - DNA, 20 bp, Artificial Sequence
  Description of Artificial Sequence: Synthetic oligonucleotide
  Target: AGXT; (+) strand; PAM type: YTN; PAM sequence: CTG
cacccaggagcccgagtgca

SEQ ID NO: 17236 - DNA, 20 bp, Artificial Sequence
  Description of Artificial Sequence: Synthetic oligonucleotide
  Target: AGXT; (+) strand; PAM type: YTN; PAM sequence: CTG
gaggccactacacactgcag

SEQ ID NO: 17237 - DNA, 20 bp, Artificial Sequence
  Description of Artificial Sequence: Synthetic oligonucleotide
  Target: AGXT; (+) strand; PAM type: YTN; PAM sequence: CTA
cacactgcaggaggtggagg

SEQ ID NO: 17238 - DNA, 20 bp, Artificial Sequence
  Description of Artificial Sequence: Synthetic oligonucleotide
  Target: AGXT; (+) strand; PAM type: YTN; PAM sequence: CTG
caggaggtggaggaggtagg

SEQ ID NO: 17239 - DNA, 20 bp, Artificial Sequence
  Description of Artificial Sequence: Synthetic oligonucleotide
  Target: AGXT; (+) strand; PAM type: YTN; PAM sequence: CTG
gctcaggggctgcctggaat

SEQ ID NO: 17240 - DNA, 20 bp, Artificial Sequence
  Description of Artificial Sequence: Synthetic oligonucleotide
  Target: AGXT; (+) strand; PAM type: YTN; PAM sequence: CTC
aggggctgcctggaattggc

SEQ ID NO: 17241 - DNA, 20 bp, Artificial Sequence
  Description of Artificial Sequence: Synthetic oligonucleotide
  Target: AGXT; (+) strand; PAM type: YTN; PAM sequence: CTG
cctggaattggccagccagc

SEQ ID NO: 17242 - DNA, 20 bp, Artificial Sequence
  Description of Artificial Sequence: Synthetic oligonucleotide
  Target: AGXT; (+) strand; PAM type: YTN; PAM sequence: CTG
gaattggccagccagcaggg

SEQ ID NO: 17243 - DNA, 20 bp, Artificial Sequence
  Description of Artificial Sequence: Synthetic oligonucleotide
  Target: AGXT; (+) strand; PAM type: YTN; PAM sequence: TTG
gccagccagcagggtgggat

SEQ ID NO: 17244 - DNA, 20 bp, Artificial Sequence
  Description of Artificial Sequence: Synthetic oligonucleotide
  Target: AGXT; (+) strand; PAM type: YTN; PAM sequence: CTG
gtggctgaccctcagcccat

SEQ ID NO: 17245 - DNA, 20 bp, Artificial Sequence
  Description of Artificial Sequence: Synthetic oligonucleotide
  Target: AGXT; (+) strand; PAM type: YTN; PAM sequence: CTG
accctcagcccatcctagca

SEQ ID NO: 17246 - DNA, 20 bp, Artificial Sequence
  Description of Artificial Sequence: Synthetic oligonucleotide
  Target: AGXT; (+) strand; PAM type: YTN; PAM sequence: CTC
agcccatcctagcatctggt

SEQ ID NO: 17247 - DNA, 20 bp, Artificial Sequence
  Description of Artificial Sequence: Synthetic oligonucleotide
  Target: AGXT; (+) strand; PAM type: YTN; PAM sequence: CTA
gcatctggtgagcggccaca

SEQ ID NO: 17248 - DNA, 20 bp, Artificial Sequence
  Description of Artificial Sequence: Synthetic oligonucleotide
  Target: AGXT; (+) strand; PAM type: YTN; PAM sequence: CTG
gtgagcggccacaggggagg

SEQ ID NO: 17249 - DNA, 20 bp, Artificial Sequence
  Description of Artificial Sequence: Synthetic oligonucleotide
  Target: AGXT; (+) strand; PAM type: YTN; PAM sequence: TTC
cattacctgggaatggtggg

SEQ ID NO: 17250 - DNA, 20 bp, Artificial Sequence
  Description of Artificial Sequence: Synthetic oligonucleotide
  Target: AGXT; (+) strand; PAM type: YTN; PAM sequence: TTA
cctgggaatggtgggaagac

SEQ ID NO: 17251 - DNA, 20 bp, Artificial Sequence
  Description of Artificial Sequence: Synthetic oligonucleotide
  Target: AGXT; (+) strand; PAM type: YTN; PAM sequence: CTG
ggaatggtgggaagactggt

SEQ ID NO: 17252 - DNA, 20 bp, Artificial Sequence
  Description of Artificial Sequence: Synthetic oligonucleotide
  Target: AGXT; (+) strand; PAM type: YTN; PAM sequence: CTG
gtaaggaggcttctgtctgg

SEQ ID NO: 17253 - DNA, 20 bp, Artificial Sequence
  Description of Artificial Sequence: Synthetic oligonucleotide
  Target: AGXT; (+) strand; PAM type: YTN; PAM sequence: CTT
ctgtctggcagggaaactga

SEQ ID NO: 17254 - DNA, 20 bp, Artificial Sequence
  Description of Artificial Sequence: Synthetic oligonucleotide
  Target: AGXT; (+) strand; PAM type: YTN; PAM sequence: TTC
tgtctggcagggaaactgag

SEQ ID NO: 17255 - DNA, 20 bp, Artificial Sequence
  Description of Artificial Sequence: Synthetic oligonucleotide
  Target: AGXT; (+) strand; PAM type: YTN; PAM sequence: CTG
tctggcagggaaactgagtc

SEQ ID NO: 17256 - DNA, 20 bp, Artificial Sequence
  Description of Artificial Sequence: Synthetic oligonucleotide
  Target: AGXT; (+) strand; PAM type: YTN; PAM sequence: CTG
gcagggaaactgagtcagga

SEQ ID NO: 17257 - DNA, 20 bp, Artificial Sequence
  Description of Artificial Sequence: Synthetic oligonucleotide
  Target: AGXT; (+) strand; PAM type: YTN; PAM sequence: CTG
agtcaggagcctggtcctgt

SEQ ID NO: 17258 - DNA, 20 bp, Artificial Sequence
  Description of Artificial Sequence: Synthetic oligonucleotide
  Target: AGXT; (+) strand; PAM type: YTN; PAM sequence: CTG
gtcctgtaggcagggccaga

SEQ ID NO: 17259 - DNA, 20 bp, Artificial Sequence
  Description of Artificial Sequence: Synthetic oligonucleotide
  Target: AGXT; (+) strand; PAM type: YTN; PAM sequence: CTG
taggcagggccagagaggct

SEQ ID NO: 17260 - DNA, 20 bp, Artificial Sequence
  Description of Artificial Sequence: Synthetic oligonucleotide
  Target: AGXT; (+) strand; PAM type: YTN; PAM sequence: CTG
gaggcaggaggccgagttgg

SEQ ID NO: 17261 - DNA, 20 bp, Artificial Sequence
  Description of Artificial Sequence: Synthetic oligonucleotide
  Target: AGXT; (+) strand; PAM type: YTN; PAM sequence: TTG
gagtctaggctgcagaacat

SEQ ID NO: 17262 - DNA, 20 bp, Artificial Sequence
  Description of Artificial Sequence: Synthetic oligonucleotide
  Target: AGXT; (+) strand; PAM type: YTN; PAM sequence: CTA
ggctgcagaacatgtccctg

SEQ ID NO: 17263 - DNA, 20 bp, Artificial Sequence
  Description of Artificial Sequence: Synthetic oligonucleotide
  Target: AGXT; (+) strand; PAM type: YTN; PAM sequence: CTG
cagaacatgtccctgacact

SEQ ID NO: 17264 - DNA, 20 bp, Artificial Sequence
  Description of Artificial Sequence: Synthetic oligonucleotide
  Target: AGXT; (+) strand; PAM type: YTN; PAM sequence: CTG
acactcaggataccccaccc

SEQ ID NO: 17265 - DNA, 20 bp, Artificial Sequence
  Description of Artificial Sequence: Synthetic oligonucleotide
  Target: AGXT; (+) strand; PAM type: YTN; PAM sequence: CTC
aggataccccaccctgtggg

SEQ ID NO: 17266 - DNA, 20 bp, Artificial Sequence
  Description of Artificial Sequence: Synthetic oligonucleotide
  Target: AGXT; (+) strand; PAM type: YTN; PAM sequence: CTG
tgggctgaagtcaacctcag

SEQ ID NO: 17267 - DNA, 20 bp, Artificial Sequence
  Description of Artificial Sequence: Synthetic oligonucleotide
  Target: AGXT; (+) strand; PAM type: YTN; PAM sequence: CTG
aagtcaacctcagcctaccc

SEQ ID NO: 17268 - DNA, 20 bp, Artificial Sequence
  Description of Artificial Sequence: Synthetic oligonucleotide
  Target: AGXT; (+) strand; PAM type: YTN; PAM sequence: CTC
agcctacccggagtgtgggg

SEQ ID NO: 17269 - DNA, 20 bp, Artificial Sequence
  Description of Artificial Sequence: Synthetic oligonucleotide
  Target: AGXT; (+) strand; PAM type: YTN; PAM sequence: CTA
cccggagtgtggggactcag

SEQ ID NO: 17270 - DNA, 20 bp, Artificial Sequence
  Description of Artificial Sequence: Synthetic oligonucleotide
  Target: AGXT; (+) strand; PAM type: YTN; PAM sequence: CTC
agtccatctagcaacagccc

SEQ ID NO: 17271 - DNA, 20 bp, Artificial Sequence
  Description of Artificial Sequence: Synthetic oligonucleotide
  Target: AGXT; (+) strand; PAM type: YTN; PAM sequence: CTA
gcaacagccctcacaggcca

SEQ ID NO: 17272 - DNA, 20 bp, Artificial Sequence
  Description of Artificial Sequence: Synthetic oligonucleotide
  Target: AGXT; (+) strand; PAM type: YTN; PAM sequence: CTC
acaggccaggcaacaggctg

SEQ ID NO: 17273 - DNA, 20 bp, Artificial Sequence
  Description of Artificial Sequence: Synthetic oligonucleotide
  Target: AGXT; (+) strand; PAM type: YTN; PAM sequence: CTG
ggggcaccctcctccatctc

SEQ ID NO: 17274 - DNA, 20 bp, Artificial Sequence
  Description of Artificial Sequence: Synthetic oligonucleotide
  Target: AGXT; (+) strand; PAM type: YTN; PAM sequence: CTC
ctccatctctgcaccaaagt

SEQ ID NO: 17275 - DNA, 20 bp, Artificial Sequence
  Description of Artificial Sequence: Synthetic oligonucleotide
  Target: AGXT; (+) strand; PAM type: YTN; PAM sequence: CTC
catctctgcaccaaagtcct

SEQ ID NO: 17276 - DNA, 20 bp, Artificial Sequence
  Description of Artificial Sequence: Synthetic oligonucleotide
  Target: AGXT; (+) strand; PAM type: YTN; PAM sequence: CTC
tgcaccaaagtcctgttctt

SEQ ID NO: 17277 - DNA, 20 bp, Artificial Sequence
  Description of Artificial Sequence: Synthetic oligonucleotide
  Target: AGXT; (+) strand; PAM type: YTN; PAM sequence: CTG
caccaaagtcctgttcttgg

SEQ ID NO: 17278 - DNA, 20 bp, Artificial Sequence
  Description of Artificial Sequence: Synthetic oligonucleotide
  Target: AGXT; (+) strand; PAM type: YTN; PAM sequence: CTG
ttcttggaaaagcccttgtc

SEQ ID NO: 17279 - DNA, 20 bp, Artificial Sequence
  Description of Artificial Sequence: Synthetic oligonucleotide
  Target: AGXT; (+) strand; PAM type: YTN; PAM sequence: TTC
ttggaaaagcccttgtcccg

SEQ ID NO: 17280 - DNA, 20 bp, Artificial Sequence
  Description of Artificial Sequence: Synthetic oligonucleotide
  Target: AGXT; (+) strand; PAM type: YTN; PAM sequence: CTT
ggaaaagcccttgtcccgga

SEQ ID NO: 17281 - DNA, 20 bp, Artificial Sequence
  Description of Artificial Sequence: Synthetic oligonucleotide
  Target: AGXT; (+) strand; PAM type: YTN; PAM sequence: TTG
gaaaagcccttgtcccggag

SEQ ID NO: 17282 - DNA, 20 bp, Artificial Sequence
  Description of Artificial Sequence: Synthetic oligonucleotide
  Target: AGXT; (+) strand; PAM type: YTN; PAM sequence: CTT
gtcccggagcggagatgccc

SEQ ID NO: 17283 - DNA, 20 bp, Artificial Sequence
  Description of Artificial Sequence: Synthetic oligonucleotide
  Target: AGXT; (+) strand; PAM type: YTN; PAM sequence: TTG
tcccggagcggagatgcccc

SEQ ID NO: 17284 - DNA, 20 bp, Artificial Sequence
  Description of Artificial Sequence: Synthetic oligonucleotide
  Target: AGXT; (+) strand; PAM type: YTN; PAM sequence: CTC
ctcctcccatgcacaccatc

SEQ ID NO: 17285 - DNA, 20 bp, Artificial Sequence
  Description of Artificial Sequence: Synthetic oligonucleotide
  Target: AGXT; (+) strand; PAM type: YTN; PAM sequence: CTC
ctcccatgcacaccatcagg

SEQ ID NO: 17286 - DNA, 20 bp, Artificial Sequence
  Description of Artificial Sequence: Synthetic oligonucleotide
  Target: AGXT; (+) strand; PAM type: YTN; PAM sequence: CTC
ccatgcacaccatcagggag

SEQ ID NO: 17287 - DNA, 20 bp, Artificial Sequence
  Description of Artificial Sequence: Synthetic oligonucleotide
  Target: AGXT; (+) strand; PAM type: YTN; PAM sequence: CTG
ctacctggagctgtgccacc

SEQ ID NO: 17288 - DNA, 20 bp, Artificial Sequence
  Description of Artificial Sequence: Synthetic oligonucleotide
  Target: AGXT; (+) strand; PAM type: YTN; PAM sequence: CTA
cctggagctgtgccacccat

SEQ ID NO: 17289 - DNA, 20 bp, Artificial Sequence
  Description of Artificial Sequence: Synthetic oligonucleotide
  Target: AGXT; (+) strand; PAM type: YTN; PAM sequence: CTG
gagctgtgccacccatgggg

SEQ ID NO: 17290 - DNA, 20 bp, Artificial Sequence
  Description of Artificial Sequence: Synthetic oligonucleotide
  Target: AGXT; (+) strand; PAM type: YTN; PAM sequence: CTG
tgccacccatggggggtttg

SEQ ID NO: 17291 - DNA, 20 bp, Artificial Sequence
  Description of Artificial Sequence: Synthetic oligonucleotide
  Target: AGXT; (+) strand; PAM type: YTN; PAM sequence: TTT
gtgggggtgttctggcccct

SEQ ID NO: 17292 - DNA, 20 bp, Artificial Sequence
  Description of Artificial Sequence: Synthetic oligonucleotide
  Target: AGXT; (+) strand; PAM type: YTN; PAM sequence: TTG
tgggggtgttctggcccctg

SEQ ID NO: 17293 - DNA, 20 bp, Artificial Sequence
  Description of Artificial Sequence: Synthetic oligonucleotide
  Target: AGXT; (+) strand; PAM type: YTN; PAM sequence: TTC
tggcccctgcccctctgagc

SEQ ID NO: 17294 - DNA, 20 bp, Artificial Sequence
  Description of Artificial Sequence: Synthetic oligonucleotide
  Target: AGXT; (+) strand; PAM type: YTN; PAM sequence: CTG
gcccctgcccctctgagctc

SEQ ID NO: 17295 - DNA, 20 bp, Artificial Sequence
  Description of Artificial Sequence: Synthetic oligonucleotide
  Target: AGXT; (+) strand; PAM type: YTN; PAM sequence: CTG
cccctctgagctccacccac

SEQ ID NO: 17296 - DNA, 20 bp, Artificial Sequence
  Description of Artificial Sequence: Synthetic oligonucleotide
  Target: AGXT; (+) strand; PAM type: YTN; PAM sequence: CTC
tgagctccacccacagccgt

SEQ ID NO: 17297 - DNA, 20 bp, Artificial Sequence
  Description of Artificial Sequence: Synthetic oligonucleotide
  Target: AGXT; (+) strand; PAM type: YTN; PAM sequence: CTG
agctccacccacagccgtcc

SEQ ID NO: 17298 - DNA, 20 bp, Artificial Sequence
  Description of Artificial Sequence: Synthetic oligonucleotide
  Target: AGXT; (+) strand; PAM type: YTN; PAM sequence: CTC
cacccacagccgtccctgct

SEQ ID NO: 17299 - DNA, 20 bp, Artificial Sequence
  Description of Artificial Sequence: Synthetic oligonucleotide
  Target: AGXT; (+) strand; PAM type: YTN; PAM sequence: CTG
cttcctcagggcctggccca

SEQ ID NO: 17300 - DNA, 20 bp, Artificial Sequence
  Description of Artificial Sequence: Synthetic oligonucleotide
  Target: AGXT; (+) strand; PAM type: YTN; PAM sequence: CTT
cctcagggcctggcccagca

SEQ ID NO: 17301 - DNA, 20 bp, Artificial Sequence
  Description of Artificial Sequence: Synthetic oligonucleotide
  Target: AGXT; (+) strand; PAM type: YTN; PAM sequence: TTC
ctcagggcctggcccagcac

SEQ ID NO: 17302 - DNA, 20 bp, Artificial Sequence
  Description of Artificial Sequence: Synthetic oligonucleotide
  Target: AGXT; (+) strand; PAM type: YTN; PAM sequence: CTC
agggcctggcccagcacaag

SEQ ID NO: 17303 - DNA, 20 bp, Artificial Sequence
  Description of Artificial Sequence: Synthetic oligonucleotide
  Target: AGXT; (+) strand; PAM type: YTN; PAM sequence: CTG
gcccagcacaagccagtgct

SEQ ID NO: 17304 - DNA, 20 bp, Artificial Sequence
  Description of Artificial Sequence: Synthetic oligonucleotide
  Target: AGXT; (+) strand; PAM type: YTN; PAM sequence: CTG
ctgttcttaacccacgggga

SEQ ID NO: 17305 - DNA, 20 bp, Artificial Sequence
  Description of Artificial Sequence: Synthetic oligonucleotide
  Target: AGXT; (+) strand; PAM type: YTN; PAM sequence: CTG
ttcttaacccacggggagtc

SEQ ID NO: 17306 - DNA, 20 bp, Artificial Sequence
  Description of Artificial Sequence: Synthetic oligonucleotide
  Target: AGXT; (+) strand; PAM type: YTN; PAM sequence: TTC
ttaacccacggggagtcgtc

SEQ ID NO: 17307 - DNA, 20 bp, Artificial Sequence
  Description of Artificial Sequence: Synthetic oligonucleotide
  Target: AGXT; (+) strand; PAM type: YTN; PAM sequence: CTT
aacccacggggagtcgtcca

SEQ ID NO: 17308 - DNA, 20 bp, Artificial Sequence
  Description of Artificial Sequence: Synthetic oligonucleotide
  Target: AGXT; (+) strand; PAM type: YTN; PAM sequence: TTA
acccacggggagtcgtccac

SEQ ID NO: 17309 - DNA, 20 bp, Artificial Sequence
  Description of Artificial Sequence: Synthetic oligonucleotide
  Target: AGXT; (+) strand; PAM type: YTN; PAM sequence: CTG
cagccccttgatggcttcgg

SEQ ID NO: 17310 - DNA, 20 bp, Artificial Sequence
  Description of Artificial Sequence: Synthetic oligonucleotide
  Target: AGXT; (+) strand; PAM type: YTN; PAM sequence: CTT
gatggcttcggggaactctg

SEQ ID NO: 17311 - DNA, 20 bp, Artificial Sequence
  Description of Artificial Sequence: Synthetic oligonucleotide
  Target: AGXT; (+) strand; PAM type: YTN; PAM sequence: TTG
atggcttcggggaactctgc

SEQ ID NO: 17312 - DNA, 20 bp, Artificial Sequence
  Description of Artificial Sequence: Synthetic oligonucleotide
  Target: AGXT; (+) strand; PAM type: YTN; PAM sequence: CTT
cggggaactctgccacaggt

SEQ ID NO: 17313 - DNA, 20 bp, Artificial Sequence
  Description of Artificial Sequence: Synthetic oligonucleotide
  Target: AGXT; (+) strand; PAM type: YTN; PAM sequence: TTC
ggggaactctgccacaggtg

SEQ ID NO: 17314 - DNA, 20 bp, Artificial Sequence
  Description of Artificial Sequence: Synthetic oligonucleotide
  Target: AGXT; (+) strand; PAM type: YTN; PAM sequence: CTC
tgccacaggtgagcctggcc

SEQ ID NO: 17315 - DNA, 20 bp, Artificial Sequence
  Description of Artificial Sequence: Synthetic oligonucleotide
  Target: AGXT; (+) strand; PAM type: YTN; PAM sequence: CTG
ccacaggtgagcctggcccc

SEQ ID NO: 17316 - DNA, 20 bp, Artificial Sequence
  Description of Artificial Sequence: Synthetic oligonucleotide
  Target: AGXT; (+) strand; PAM type: YTN; PAM sequence: CTG
gccccagggcggtggactgg

SEQ ID NO: 17317 - DNA, 20 bp, Artificial Sequence
  Description of Artificial Sequence: Synthetic oligonucleotide
  Target: AGXT; (+) strand; PAM type: YTN; PAM sequence: CTG
gagcacagctcagagccagg

SEQ ID NO: 17318 - DNA, 20 bp, Artificial Sequence
  Description of Artificial Sequence: Synthetic oligonucleotide
  Target: AGXT; (+) strand; PAM type: YTN; PAM sequence: CTC
agagccaggctatggggagg

SEQ ID NO: 17319 - DNA, 20 bp, Artificial Sequence
  Description of Artificial Sequence: Synthetic oligonucleotide
  Target: AGXT; (+) strand; PAM type: YTN; PAM sequence: CTA
tggggaggggtgggcactgg

SEQ ID NO: 17320 - DNA, 20 bp, Artificial Sequence
  Description of Artificial Sequence: Synthetic oligonucleotide
  Target: AGXT; (+) strand; PAM type: YTN; PAM sequence: CTG
gtccctctggtccttctgcc

SEQ ID NO: 17321 - DNA, 20 bp, Artificial Sequence
  Description of Artificial Sequence: Synthetic oligonucleotide
  Target: AGXT; (+) strand; PAM type: YTN; PAM sequence: CTC
tggtccttctgcccctggtc

SEQ ID NO: 17322 - DNA, 20 bp, Artificial Sequence
  Description of Artificial Sequence: Synthetic oligonucleotide
  Target: AGXT; (+) strand; PAM type: YTN; PAM sequence: CTG
gtccttctgcccctggtccc

SEQ ID NO: 17323 - DNA, 20 bp, Artificial Sequence
  Description of Artificial Sequence: Synthetic oligonucleotide
  Target: AGXT; (+) strand; PAM type: YTN; PAM sequence: CTT
ctgcccctggtccccacccc

SEQ ID NO: 17324 - DNA, 20 bp, Artificial Sequence
  Description of Artificial Sequence: Synthetic oligonucleotide
  Target: AGXT; (+) strand; PAM type: YTN; PAM sequence: TTC
tgcccctggtccccacccca

SEQ ID NO: 17325 - DNA, 20 bp, Artificial Sequence
  Description of Artificial Sequence: Synthetic oligonucleotide
  Target: AGXT; (+) strand; PAM type: YTN; PAM sequence: CTG
cccctggtccccaccccagc

SEQ ID NO: 17326 - DNA, 20 bp, Artificial Sequence
  Description of Artificial Sequence: Synthetic oligonucleotide
  Target: AGXT; (+) strand; PAM type: YTN; PAM sequence: CTG
gtccccaccccagcctctgt

SEQ ID NO: 17327 - DNA, 20 bp, Artificial Sequence
  Description of Artificial Sequence: Synthetic oligonucleotide
  Target: AGXT; (+) strand; PAM type: YTN; PAM sequence: CTC
tgtcacatggtatggggtgc

SEQ ID NO: 17328 - DNA, 20 bp, Artificial Sequence
  Description of Artificial Sequence: Synthetic oligonucleotide
  Target: AGXT; (+) strand; PAM type: YTN; PAM sequence: CTG
tcacatggtatggggtgcag

SEQ ID NO: 17329 - DNA, 20 bp, Artificial Sequence
  Description of Artificial Sequence: Synthetic oligonucleotide
  Target: AGXT; (+) strand; PAM type: YTN; PAM sequence: CTC
ccaggtcctctttgctctgg

SEQ ID NO: 17330 - DNA, 20 bp, Artificial Sequence
  Description of Artificial Sequence: Synthetic oligonucleotide
  Target: AGXT; (+) strand; PAM type: YTN; PAM sequence: CTC
tttgctctgggctgagtcta

SEQ ID NO: 17331 - DNA, 20 bp, Artificial Sequence
  Description of Artificial Sequence: Synthetic oligonucleotide
  Target: AGXT; (+) strand; PAM type: YTN; PAM sequence: CTT
tgctctgggctgagtctaaa

SEQ ID NO: 17332 - DNA, 20 bp, Artificial Sequence
  Description of Artificial Sequence: Synthetic oligonucleotide
  Target: AGXT; (+) strand; PAM type: YTN; PAM sequence: TTT
gctctgggctgagtctaaag

SEQ ID NO: 17333 - DNA, 20 bp, Artificial Sequence
  Description of Artificial Sequence: Synthetic oligonucleotide
  Target: AGXT; (+) strand; PAM type: YTN; PAM sequence: TTG
ctctgggctgagtctaaaga

SEQ ID NO: 17334 - DNA, 20 bp, Artificial Sequence
  Description of Artificial Sequence: Synthetic oligonucleotide
  Target: AGXT; (+) strand; PAM type: YTN; PAM sequence: CTC
tgggctgagtctaaagacaa

SEQ ID NO: 17335 - DNA, 20 bp, Artificial Sequence
  Description of Artificial Sequence: Synthetic oligonucleotide
  Target: AGXT; (+) strand; PAM type: YTN; PAM sequence: CTG
ggctgagtctaaagacaacc

SEQ ID NO: 17336 - DNA, 20 bp, Artificial Sequence
  Description of Artificial Sequence: Synthetic oligonucleotide
  Target: AGXT; (+) strand; PAM type: YTN; PAM sequence: CTG
agtctaaagacaaccccagg

SEQ ID NO: 17337 - DNA, 20 bp, Artificial Sequence
  Description of Artificial Sequence: Synthetic oligonucleotide
  Target: AGXT; (+) strand; PAM type: YTN; PAM sequence: CTA
aagacaaccccaggtcccag

SEQ ID NO: 17338 - DNA, 20 bp, Artificial Sequence
  Description of Artificial Sequence: Synthetic oligonucleotide
  Target: AGXT; (+) strand; PAM type: YTN; PAM sequence: CTC
aggtgctccctggccgagcg

SEQ ID NO: 17339 - DNA, 20 bp, Artificial Sequence
  Description of Artificial Sequence: Synthetic oligonucleotide
  Target: AGXT; (+) strand; PAM type: YTN; PAM sequence: CTC
cctggccgagcgcccccata

SEQ ID NO: 17340 - DNA, 20 bp, Artificial Sequence
  Description of Artificial Sequence: Synthetic oligonucleotide
  Target: AGXT; (+) strand; PAM type: YTN; PAM sequence: CTG
gccgagcgcccccatagtgc

SEQ ID NO: 17341 - DNA, 20 bp, Artificial Sequence
  Description of Artificial Sequence: Synthetic oligonucleotide
  Target: AGXT; (+) strand; PAM type: YTN; PAM sequence: CTG
acctctgtccccagggctga

SEQ ID NO: 17342 - DNA, 20 bp, Artificial Sequence
  Description of Artificial Sequence: Synthetic oligonucleotide
  Target: AGXT; (+) strand; PAM type: YTN; PAM sequence: CTC
tgtccccagggctgaagagg

SEQ ID NO: 17343 - DNA, 20 bp, Artificial Sequence
  Description of Artificial Sequence: Synthetic oligonucleotide
  Target: AGXT; (+) strand; PAM type: YTN; PAM sequence: CTG
tccccagggctgaagagggc

SEQ ID NO: 17344 - DNA, 20 bp, Artificial Sequence
  Description of Artificial Sequence: Synthetic oligonucleotide
  Target: AGXT; (+) strand; PAM type: YTN; PAM sequence: CTG
aagagggcttggtgcagact

SEQ ID NO: 17345 - DNA, 20 bp, Artificial Sequence
  Description of Artificial Sequence: Synthetic oligonucleotide
  Target: AGXT; (+) strand; PAM type: YTN; PAM sequence: CTT
ggtgcagacttccatatctt

SEQ ID NO: 17346 - DNA, 20 bp, Artificial Sequence
  Description of Artificial Sequence: Synthetic oligonucleotide
  Target: AGXT; (+) strand; PAM type: YTN; PAM sequence: TTG
gtgcagacttccatatcttg

SEQ ID NO: 17347 - DNA, 20 bp, Artificial Sequence
  Description of Artificial Sequence: Synthetic oligonucleotide
  Target: AGXT; (+) strand; PAM type: YTN; PAM sequence: CTT
ccatatcttgccagggcctg

SEQ ID NO: 17348 - DNA, 20 bp, Artificial Sequence
  Description of Artificial Sequence: Synthetic oligonucleotide
  Target: AGXT; (+) strand; PAM type: YTN; PAM sequence: TTC
catatcttgccagggcctgt

SEQ ID NO: 17349 - DNA, 20 bp, Artificial Sequence
  Description of Artificial Sequence: Synthetic oligonucleotide
  Target: AGXT; (+) strand; PAM type: YTN; PAM sequence: CTT
gccagggcctgtccccacct

SEQ ID NO: 17350 - DNA, 20 bp, Artificial Sequence
  Description of Artificial Sequence: Synthetic oligonucleotide
  Target: AGXT; (+) strand; PAM type: YTN; PAM sequence: TTG
ccagggcctgtccccacctc

SEQ ID NO: 17351 - DNA, 20 bp, Artificial Sequence
  Description of Artificial Sequence: Synthetic oligonucleotide
  Target: AGXT; (+) strand; PAM type: YTN; PAM sequence: CTG
tccccacctcaccccgagat

SEQ ID NO: 17352 - DNA, 20 bp, Artificial Sequence
  Description of Artificial Sequence: Synthetic oligonucleotide
  Target: AGXT; (+) strand; PAM type: YTN; PAM sequence: CTC
accccgagattgccaggaca

SEQ ID NO: 17353 - DNA, 20 bp, Artificial Sequence
  Description of Artificial Sequence: Synthetic oligonucleotide
  Target: AGXT; (+) strand; PAM type: YTN; PAM sequence: TTG
ccaggacactaaagctgcct

SEQ ID NO: 17354 - DNA, 20 bp, Artificial Sequence
  Description of Artificial Sequence: Synthetic oligonucleotide
  Target: AGXT; (+) strand; PAM type: YTN; PAM sequence: CTA
aagctgcctgatgccctcca

SEQ ID NO: 17355 - DNA, 20 bp, Artificial Sequence
  Description of Artificial Sequence: Synthetic oligonucleotide
  Target: AGXT; (+) strand; PAM type: YTN; PAM sequence: CTG
cctgatgccctccacttccc

SEQ ID NO: 17356 - DNA, 20 bp, Artificial Sequence
  Description of Artificial Sequence: Synthetic oligonucleotide
  Target: AGXT; (+) strand; PAM type: YTN; PAM sequence: CTG
atgccctccacttccctcct

SEQ ID NO: 17357 - DNA, 20 bp, Artificial Sequence
  Description of Artificial Sequence: Synthetic oligonucleotide
  Target: AGXT; (+) strand; PAM type: YTN; PAM sequence: CTC
cacttccctcctccagcctc

SEQ ID NO: 17358 - DNA, 20 bp, Artificial Sequence
  Description of Artificial Sequence: Synthetic oligonucleotide
  Target: AGXT; (+) strand; PAM type: YTN; PAM sequence: CTT
ccctcctccagcctccctca

SEQ ID NO: 17359 - DNA, 20 bp, Artificial Sequence
  Description of Artificial Sequence: Synthetic oligonucleotide
  Target: AGXT; (+) strand; PAM type: YTN; PAM sequence: TTC
cctcctccagcctccctcat

SEQ ID NO: 17360 - DNA, 20 bp, Artificial Sequence
  Description of Artificial Sequence: Synthetic oligonucleotide
  Target: AGXT; (+) strand; PAM type: YTN; PAM sequence: CTC
ctccagcctccctcatcccc

SEQ ID NO: 17361 - DNA, 20 bp, Artificial Sequence
  Description of Artificial Sequence: Synthetic oligonucleotide
  Target: AGXT; (+) strand; PAM type: YTN; PAM sequence: CTC
cagcctccctcatccccgca

SEQ ID NO: 17362 - DNA, 20 bp, Artificial Sequence
  Description of Artificial Sequence: Synthetic oligonucleotide
  Target: AGXT; (+) strand; PAM type: YTN; PAM sequence: CTC
cctcatccccgcatgggggt

SEQ ID NO: 17363 - DNA, 20 bp, Artificial Sequence
  Description of Artificial Sequence: Synthetic oligonucleotide
  Target: AGXT; (+) strand; PAM type: YTN; PAM sequence: CTC
atccccgcatgggggtgcac

SEQ ID NO: 17364 - DNA, 20 bp, Artificial Sequence
  Description of Artificial Sequence: Synthetic oligonucleotide
  Target: AGXT; (+) strand; PAM type: YTN; PAM sequence: CTT
gaatggagtcagatgggatt

SEQ ID NO: 17365 - DNA, 20 bp, Artificial Sequence
  Description of Artificial Sequence: Synthetic oligonucleotide
  Target: AGXT; (+) strand; PAM type: YTN; PAM sequence: TTG
aatggagtcagatgggattc

SEQ ID NO: 17366 - DNA, 20 bp, Artificial Sequence
  Description of Artificial Sequence: Synthetic oligonucleotide
  Target: AGXT; (+) strand; PAM type: YTN; PAM sequence: TTC
ctgagaaatgcggacagagc

SEQ ID NO: 17367 - DNA, 20 bp, Artificial Sequence
  Description of Artificial Sequence: Synthetic oligonucleotide
  Target: AGXT; (+) strand; PAM type: YTN; PAM sequence: CTG
agaaatgcggacagagcccc

SEQ ID NO: 17368 - DNA, 20 bp, Artificial Sequence
  Description of Artificial Sequence: Synthetic oligonucleotide
  Target: AGXT; (+) strand; PAM type: YTN; PAM sequence: CTT
gggacccagcagtcccgtct

SEQ ID NO: 17369 - DNA, 20 bp, Artificial Sequence
  Description of Artificial Sequence: Synthetic oligonucleotide
  Target: AGXT; (+) strand; PAM type: YTN; PAM sequence: TTG
ggacccagcagtcccgtctg

SEQ ID NO: 17370 - DNA, 20 bp, Artificial Sequence
  Description of Artificial Sequence: Synthetic oligonucleotide
  Target: AGXT; (+) strand; PAM type: YTN; PAM sequence: CTG
caggtctgagcacaggacag

SEQ ID NO: 17371 - DNA, 20 bp, Artificial Sequence
  Description of Artificial Sequence: Synthetic oligonucleotide
  Target: AGXT; (+) strand; PAM type: YTN; PAM sequence: CTG
agcacaggacagaggagaga

SEQ ID NO: 17372 - DNA, 20 bp, Artificial Sequence
  Description of Artificial Sequence: Synthetic oligonucleotide
  Target: AGXT; (+) strand; PAM type: YTN; PAM sequence: CTC
cacggccagggagggtcctt

SEQ ID NO: 17373 - DNA, 20 bp, Artificial Sequence
  Description of Artificial Sequence: Synthetic oligonucleotide
  Target: AGXT; (+) strand; PAM type: YTN; PAM sequence: CTT
ctgacagggcccccagccca

SEQ ID NO: 17374 - DNA, 20 bp, Artificial Sequence
  Description of Artificial Sequence: Synthetic oligonucleotide
  Target: AGXT; (+) strand; PAM type: YTN; PAM sequence: TTC
tgacagggcccccagcccag

SEQ ID NO: 17375 - DNA, 20 bp, Artificial Sequence
  Description of Artificial Sequence: Synthetic oligonucleotide
  Target: AGXT; (+) strand; PAM type: YTN; PAM sequence: CTG
acagggcccccagcccagac

SEQ ID NO: 17376 - DNA, 20 bp, Artificial Sequence
  Description of Artificial Sequence: Synthetic oligonucleotide
  Target: AGXT; (+) strand; PAM type: YTN; PAM sequence: CTT
gctgcatggaccgtggccat

SEQ ID NO: 17377 - DNA, 20 bp, Artificial Sequence
  Description of Artificial Sequence: Synthetic oligonucleotide
  Target: AGXT; (+) strand; PAM type: YTN; PAM sequence: TTG
ctgcatggaccgtggccatg

SEQ ID NO: 17378 - DNA, 20 bp, Artificial Sequence
  Description of Artificial Sequence: Synthetic oligonucleotide
  Target: AGXT; (+) strand; PAM type: YTN; PAM sequence: CTG
catggaccgtggccatgaat

SEQ ID NO: 17379 - DNA, 20 bp, Artificial Sequence
  Description of Artificial Sequence: Synthetic oligonucleotide
  Target: AGXT; (+) strand; PAM type: YTN; PAM sequence: CTC
acaaacataacctggccagc

SEQ ID NO: 17380 - DNA, 20 bp, Artificial Sequence
  Description of Artificial Sequence: Synthetic oligonucleotide
  Target: AGXT; (+) strand; PAM type: YTN; PAM sequence: CTG
gccagcttcagcaacaccca

SEQ ID NO: 17381 - DNA, 20 bp, Artificial Sequence
  Description of Artificial Sequence: Synthetic oligonucleotide
  Target: AGXT; (+) strand; PAM type: YTN; PAM sequence: CTT
cagcaacacccaggccatcc

SEQ ID NO: 17382 - DNA, 20 bp, Artificial Sequence
  Description of Artificial Sequence: Synthetic oligonucleotide
  Target: AGXT; (+) strand; PAM type: YTN; PAM sequence: TTC
agcaacacccaggccatccc

SEQ ID NO: 17383 - DNA, 20 bp, Artificial Sequence
  Description of Artificial Sequence: Synthetic oligonucleotide
  Target: AGXT; (+) strand; PAM type: YTN; PAM sequence: CTG
cggccagcacgagatacttt

SEQ ID NO: 17384 - DNA, 20 bp, Artificial Sequence
  Description of Artificial Sequence: Synthetic oligonucleotide
  Target: AGXT; (+) strand; PAM type: YTN; PAM sequence: CTT
tctgtgtctcttttttcttt

SEQ ID NO: 17385 - DNA, 20 bp, Artificial Sequence
  Description of Artificial Sequence: Synthetic oligonucleotide
  Target: AGXT; (+) strand; PAM type: YTN; PAM sequence: TTT
ctgtgtctcttttttcttta

SEQ ID NO: 17386 - DNA, 20 bp, Artificial Sequence
  Description of Artificial Sequence: Synthetic oligonucleotide
  Target: AGXT; (+) strand; PAM type: YTN; PAM sequence: TTC
tgtgtctcttttttctttat

SEQ ID NO: 17387 - DNA, 20 bp, Artificial Sequence
  Description of Artificial Sequence: Synthetic oligonucleotide
  Target: AGXT; (+) strand; PAM type: YTN; PAM sequence: CTG
tgtctcttttttctttataa

SEQ ID NO: 17388 - DNA, 20 bp, Artificial Sequence
  Description of Artificial Sequence: Synthetic oligonucleotide
  Target: AGXT; (+) strand; PAM type: YTN; PAM sequence: CTC
ttttttctttataagaaaac

SEQ ID NO: 17389 - DNA, 20 bp, Artificial Sequence
  Description of Artificial Sequence: Synthetic oligonucleotide
  Target: AGXT; (+) strand; PAM type: YTN; PAM sequence: CTT
ttttctttataagaaaacct

SEQ ID NO: 17390 - DNA, 20 bp, Artificial Sequence
  Description of Artificial Sequence: Synthetic oligonucleotide
  Target: AGXT; (+) strand; PAM type: YTN; PAM sequence: TTT
tttctttataagaaaacctg

SEQ ID NO: 17391 - DNA, 20 bp, Artificial Sequence
  Description of Artificial Sequence: Synthetic oligonucleotide
  Target: AGXT; (+) strand; PAM type: YTN; PAM sequence: TTT
ttctttataagaaaacctgg

SEQ ID NO: 17392 - DNA, 20 bp, Artificial Sequence
  Description of Artificial Sequence: Synthetic oligonucleotide
  Target: AGXT; (+) strand; PAM type: YTN; PAM sequence: TTT
tctttataagaaaacctgga

SEQ ID NO: 17393 - DNA, 20 bp, Artificial Sequence
  Description of Artificial Sequence: Synthetic oligonucleotide
  Target: AGXT; (+) strand; PAM type: YTN; PAM sequence: TTT
ctttataagaaaacctggag

SEQ ID NO: 17394 - DNA, 20 bp, Artificial Sequence
  Description of Artificial Sequence: Synthetic oligonucleotide
  Target: AGXT; (+) strand; PAM type: YTN; PAM sequence: TTC
tttataagaaaacctggagg

SEQ ID NO: 17395 - DNA, 20 bp, Artificial Sequence
  Description of Artificial Sequence: Synthetic oligonucleotide
  Target: AGXT; (+) strand; PAM type: YTN; PAM sequence: CTT
tataagaaaacctggaggtg

SEQ ID NO: 17396 - DNA, 20 bp, Artificial Sequence
  Description of Artificial Sequence: Synthetic oligonucleotide
  Target: AGXT; (+) strand; PAM type: YTN; PAM sequence: TTT
ataagaaaacctggaggtgg

SEQ ID NO: 17397 - DNA, 20 bp, Artificial Sequence
  Description of Artificial Sequence: Synthetic oligonucleotide
  Target: AGXT; (+) strand; PAM type: YTN; PAM sequence: TTA
taagaaaacctggaggtgga

SEQ ID NO: 17398 - DNA, 20 bp, Artificial Sequence
  Description of Artificial Sequence: Synthetic oligonucleotide
  Target: AGXT; (+) strand; PAM type: YTN; PAM sequence: CTG
gaggtggaggagggtgagag

SEQ ID NO: 17399 - DNA, 20 bp, Artificial Sequence
  Description of Artificial Sequence: Synthetic oligonucleotide
  Target: AGXT; (+) strand; PAM type: YTN; PAM sequence: TTT
gtgaacatggaggcggagga

SEQ ID NO: 17400 - DNA, 20 bp, Artificial Sequence
  Description of Artificial Sequence: Synthetic oligonucleotide
  Target: AGXT; (+) strand; PAM type: YTN; PAM sequence: TTG
tgaacatggaggcggaggag

SEQ ID NO: 17401 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggcggagga

SEQ ID NO: 17402 - DNA, 20 bp, Artificial Sequence
  Description of Artificial Sequence: Synthetic oligonucleotide
  Target: AGXT; (+) strand; PAM type: YTN; PAM sequence: TTC
gtgaacatgtaggtggagga

SEQ ID NO: 17403 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggaggaggg

SEQ ID NO: 17404 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggaggagga

SEQ ID NO: 17405 - DNA, 20 bp, Artificial Sequence
  Description of Artificial Sequence: Synthetic oligonucleotide
  Target: AGXT; (+) strand; PAM type: YTN; PAM sequence: TTC
gtgaacatggaggaggagga

SEQ ID NO: 17406 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggcggagga

SEQ ID NO: 17407 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggtggagga

SEQ ID NO: 17408 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggaggaggg

SEQ ID NO: 17409 - DNA, 20 bp, Artificial Sequence
  Description of Artificial Sequence: Synthetic oligonucleotide
  Target: AGXT; (+) strand; PAM type: YTN; PAM sequence: TTC
gtgaacatgcaggaggagga

SEQ ID NO: 17410 - DNA, 20 bp, Artificial Sequence
  Description of Artificial Sequence: Synthetic oligonucleotide
  Target: AGXT; (+) strand; PAM type: YTN; PAM sequence: TTC
gtgaacatggaggcggagga

SEQ ID NO: 17411 - DNA, 20 bp, Artificial Sequence
  Description of Artificial Sequence: Synthetic oligonucleotide
  Target: AGXT; (+) strand; PAM type: YTN; PAM sequence: TTT
gtggcgctgctgcttgggct

SEQ ID NO: 17412 - DNA, 20 bp, Artificial Sequence
  Description of Artificial Sequence: Synthetic oligonucleotide
  Target: AGXT; (+) strand; PAM type: YTN; PAM sequence: TTG
tggcgctgctgcttgggctg

SEQ ID NO: 17413 - DNA, 20 bp, Artificial Sequence
  Description of Artificial Sequence: Synthetic oligonucleotide
  Target: AGXT; (+) strand; PAM type: YTN; PAM sequence: CTG
ctgcttgggctgttctggga

SEQ ID NO: 17414 - DNA, 20 bp, Artificial Sequence
  Description of Artificial Sequence: Synthetic oligonucleotide
  Target: AGXT; (+) strand; PAM type: YTN; PAM sequence: CTG
cttgggctgttctgggactc

SEQ ID NO: 17415 - DNA, 20 bp, Artificial Sequence
  Description of Artificial Sequence: Synthetic oligonucleotide
  Target: AGXT; (+) strand; PAM type: YTN; PAM sequence: CTT
gggctgttctgggactctgt

SEQ ID NO: 17416 - DNA, 20 bp, Artificial Sequence
  Description of Artificial Sequence: Synthetic oligonucleotide
  Target: AGXT; (+) strand; PAM type: YTN; PAM sequence: TTG
ggctgttctgggactctgtc

SEQ ID NO: 17417 - DNA, 20 bp, Artificial Sequence
  Description of Artificial Sequence: Synthetic oligonucleotide
  Target: AGXT; (+) strand; PAM type: YTN; PAM sequence: CTG
ttctgggactctgtcccctc

SEQ ID NO: 17418 - DNA, 20 bp, Artificial Sequence
  Description of Artificial Sequence: Synthetic oligonucleotide
  Target: AGXT; (+) strand; PAM type: YTN; PAM sequence: TTC
tgggactctgtcccctctgg

SEQ ID NO: 17419 - DNA, 20 bp, Artificial Sequence
  Description of Artificial Sequence: Synthetic oligonucleotide
  Target: AGXT; (+) strand; PAM type: YTN; PAM sequence: CTG
ggactctgtcccctctggcc

SEQ ID NO: 17420 - DNA, 20 bp, Artificial Sequence
  Description of Artificial Sequence: Synthetic oligonucleotide
  Target: AGXT; (+) strand; PAM type: YTN; PAM sequence: CTC
tgtcccctctggcctagatt

SEQ ID NO: 17421 - DNA, 20 bp, Artificial Sequence
  Description of Artificial Sequence: Synthetic oligonucleotide
  Target: AGXT; (+) strand; PAM type: YTN; PAM sequence: CTG
tcccctctggcctagattct

SEQ ID NO: 17422 - DNA, 20 bp, Artificial Sequence
  Description of Artificial Sequence: Synthetic oligonucleotide
  Target: AGXT; (+) strand; PAM type: YTN; PAM sequence: CTC
tggcctagattctggccagt

SEQ ID NO: 17423 - DNA, 20 bp, Artificial Sequence
  Description of Artificial Sequence: Synthetic oligonucleotide
  Target: AGXT; (+) strand; PAM type: YTN; PAM sequence: CTG
gcctagattctggccagtgg

SEQ ID NO: 17424 - DNA, 20 bp, Artificial Sequence
  Description of Artificial Sequence: Synthetic oligonucleotide
  Target: AGXT; (+) strand; PAM type: YTN; PAM sequence: CTA
gattctggccagtggctggg

SEQ ID NO: 17425 - DNA, 20 bp, Artificial Sequence
  Description of Artificial Sequence: Synthetic oligonucleotide
  Target: AGXT; (+) strand; PAM type: YTN; PAM sequence: TTC
tggccagtggctgggccgag

SEQ ID NO: 17426 - DNA, 20 bp, Artificial Sequence
  Description of Artificial Sequence: Synthetic oligonucleotide
  Target: AGXT; (+) strand; PAM type: YTN; PAM sequence: CTG
gccagtggctgggccgagca

SEQ ID NO: 17427 - DNA, 20 bp, Artificial Sequence
  Description of Artificial Sequence: Synthetic oligonucleotide
  Target: AGXT; (+) strand; PAM type: YTN; PAM sequence: CTG
ggccgagcagctgttggcag

SEQ ID NO: 17428 - DNA, 20 bp, Artificial Sequence
  Description of Artificial Sequence: Synthetic oligonucleotide
  Target: AGXT; (+) strand; PAM type: YTN; PAM sequence: CTG
ttggcagaggtaggcccagc

SEQ ID NO: 17429 - DNA, 20 bp, Artificial Sequence
  Description of Artificial Sequence: Synthetic oligonucleotide
  Target: AGXT; (+) strand; PAM type: YTN; PAM sequence: TTG
gcagaggtaggcccagcctg

SEQ ID NO: 17430 - DNA, 20 bp, Artificial Sequence
  Description of Artificial Sequence: Synthetic oligonucleotide
  Target: AGXT; (+) strand; PAM type: YTN; PAM sequence: CTG
gtgccaccctggtccctggg

SEQ ID NO: 17431 - DNA, 20 bp, Artificial Sequence
  Description of Artificial Sequence: Synthetic oligonucleotide
  Target: AGXT; (+) strand; PAM type: YTN; PAM sequence: CTG
gtccctggggtccacacagg

SEQ ID NO: 17432 - DNA, 20 bp, Artificial Sequence
  Description of Artificial Sequence: Synthetic oligonucleotide
  Target: AGXT; (+) strand; PAM type: YTN; PAM sequence: CTG
gggtccacacaggccctcag

SEQ ID NO: 17433 - DNA, 20 bp, Artificial Sequence
  Description of Artificial Sequence: Synthetic oligonucleotide
  Target: AGXT; (+) strand; PAM type: YTN; PAM sequence: CTC
aggcacccgctgtccctggg

SEQ ID NO: 17434 - DNA, 20 bp, Artificial Sequence
  Description of Artificial Sequence: Synthetic oligonucleotide
  Target: AGXT; (+) strand; PAM type: YTN; PAM sequence: CTG
tccctgggaaccacagactg

SEQ ID NO: 17435 - DNA, 20 bp, Artificial Sequence
  Description of Artificial Sequence: Synthetic oligonucleotide
  Target: AGXT; (+) strand; PAM type: YTN; PAM sequence: CTG
ggaaccacagactgcccggc

SEQ ID NO: 17436 - DNA, 20 bp, Artificial Sequence
  Description of Artificial Sequence: Synthetic oligonucleotide
  Target: AGXT; (+) strand; PAM type: YTN; PAM sequence: CTG
cccggctgaccctcttcagc

SEQ ID NO: 17437 - DNA, 20 bp, Artificial Sequence
  Description of Artificial Sequence: Synthetic oligonucleotide
  Target: AGXT; (+) strand; PAM type: YTN; PAM sequence: CTG
accctcttcagcaccactgc

SEQ ID NO: 17438 - DNA, 20 bp, Artificial Sequence
  Description of Artificial Sequence: Synthetic oligonucleotide
  Target: AGXT; (+) strand; PAM type: YTN; PAM sequence: CTC
ttcagcaccactgccgggcc

SEQ ID NO: 17439 - DNA, 20 bp, Artificial Sequence
  Description of Artificial Sequence: Synthetic oligonucleotide
  Target: AGXT; (+) strand; PAM type: YTN; PAM sequence: CTT
cagcaccactgccgggccct

SEQ ID NO: 17440 - DNA, 20 bp, Artificial Sequence
  Description of Artificial Sequence: Synthetic oligonucleotide
  Target: AGXT; (+) strand; PAM type: YTN; PAM sequence: TTC
agcaccactgccgggccctg

SEQ ID NO: 17441 - DNA, 20 bp, Artificial Sequence
  Description of Artificial Sequence: Synthetic oligonucleotide
  Target: AGXT; (+) strand; PAM type: YTN; PAM sequence: CTG
ccgggccctgcagctgggtc

SEQ ID NO: 17442 - DNA, 20 bp, Artificial Sequence
  Description of Artificial Sequence: Synthetic oligonucleotide
  Target: AGXT; (+) strand; PAM type: YTN; PAM sequence: CTG
cagctgggtctcaccagggc

SEQ ID NO: 17443 - DNA, 20 bp, Artificial Sequence
  Description of Artificial Sequence: Synthetic oligonucleotide
  Target: AGXT; (+) strand; PAM type: YTN; PAM sequence: CTG
ggtctcaccagggccgtgat

SEQ ID NO: 17444 - DNA, 20 bp, Artificial Sequence
  Description of Artificial Sequence: Synthetic oligonucleotide
  Target: AGXT; (+) strand; PAM type: YTN; PAM sequence: CTC
accagggccgtgatgctccc

SEQ ID NO: 17445 - DNA, 20 bp, Artificial Sequence
  Description of Artificial Sequence: Synthetic oligonucleotide
  Target: AGXT; (+) strand; PAM type: YTN; PAM sequence: CTC
cctcactcccccagctccct

SEQ ID NO: 17446 - DNA, 20 bp, Artificial Sequence
  Description of Artificial Sequence: Synthetic oligonucleotide
  Target: AGXT; (+) strand; PAM type: YTN; PAM sequence: CTC
actcccccagctccctctgc

SEQ ID NO: 17447 - DNA, 20 bp, Artificial Sequence
  Description of Artificial Sequence: Synthetic oligonucleotide
  Target: AGXT; (+) strand; PAM type: YTN; PAM sequence: CTC
ccccagctccctctgctcca

SEQ ID NO: 17448 - DNA, 20 bp, Artificial Sequence
  Description of Artificial Sequence: Synthetic oligonucleotide
  Target: AGXT; (+) strand; PAM type: YTN; PAM sequence: CTC
cctctgctccaatgttcagg

SEQ ID NO: 17449 - DNA, 20 bp, Artificial Sequence
  Description of Artificial Sequence: Synthetic oligonucleotide
  Target: AGXT; (+) strand; PAM type: YTN; PAM sequence: CTC
tgctccaatgttcagggctg

SEQ ID NO: 17450 - DNA, 20 bp, Artificial Sequence
  Description of Artificial Sequence: Synthetic oligonucleotide
  Target: AGXT; (+) strand; PAM type: YTN; PAM sequence: CTG
ctccaatgttcagggctgag

SEQ ID NO: 17451 - DNA, 20 bp, Artificial Sequence
  Description of Artificial Sequence: Synthetic oligonucleotide
  Target: AGXT; (+) strand; PAM type: YTN; PAM sequence: CTC
caatgttcagggctgagaaa

SEQ ID NO: 17452 - DNA, 20 bp, Artificial Sequence
  Description of Artificial Sequence: Synthetic oligonucleotide
  Target: AGXT; (+) strand; PAM type: YTN; PAM sequence: TTC
agggctgagaaaggaagagc

SEQ ID NO: 17453 - DNA, 20 bp, Artificial Sequence
  Description of Artificial Sequence: Synthetic oligonucleotide
  Target: AGXT; (+) strand; PAM type: YTN; PAM sequence: CTG
agaaaggaagagccacaggt

SEQ ID NO: 17454 - DNA, 20 bp, Artificial Sequence
  Description of Artificial Sequence: Synthetic oligonucleotide
  Target: AGXT; (+) strand; PAM type: YTN; PAM sequence: CTG
atggatcctgacaggcagga

SEQ ID NO: 17455 - DNA, 20 bp, Artificial Sequence
  Description of Artificial Sequence: Synthetic oligonucleotide
  Target: AGXT; (+) strand; PAM type: YTN; PAM sequence: CTG
acaggcaggagaaggcaact

SEQ ID NO: 17456 - DNA, 20 bp, Artificial Sequence
  Description of Artificial Sequence: Synthetic oligonucleotide
  Target: AGXT; (+) strand; PAM type: YTN; PAM sequence: CTG
gccaactcctggggtggagg

SEQ ID NO: 17457 - DNA, 20 bp, Artificial Sequence
  Description of Artificial Sequence: Synthetic oligonucleotide
  Target: AGXT; (+) strand; PAM type: YTN; PAM sequence: CTC
ctggggtggaggtgggaggt

SEQ ID NO: 17458 - DNA, 20 bp, Artificial Sequence
  Description of Artificial Sequence: Synthetic oligonucleotide
  Target: AGXT; (+) strand; PAM type: YTN; PAM sequence: CTG
gggtggaggtgggaggtgcc

SEQ ID NO: 17459 - DNA, 20 bp, Artificial Sequence
  Description of Artificial Sequence: Synthetic oligonucleotide
  Target: AGXT; (+) strand; PAM type: YTN; PAM sequence: CTG
ccttccttgccagcctgagg

SEQ ID NO: 17460 - DNA, 20 bp, Artificial Sequence
  Description of Artificial Sequence: Synthetic oligonucleotide
  Target: AGXT; (+) strand; PAM type: YTN; PAM sequence: CTT
ccttgccagcctgaggctca

SEQ ID NO: 17461 - DNA, 20 bp, Artificial Sequence
  Description of Artificial Sequence: Synthetic oligonucleotide
  Target: AGXT; (+) strand; PAM type: YTN; PAM sequence: TTC
cttgccagcctgaggctcag

SEQ ID NO: 17462 - DNA, 20 bp, Artificial Sequence
  Description of Artificial Sequence: Synthetic oligonucleotide
  Target: AGXT; (+) strand; PAM type: YTN; PAM sequence: CTT
gccagcctgaggctcagaaa

SEQ ID NO: 17463 - DNA, 20 bp, Artificial Sequence
  Description of Artificial Sequence: Synthetic oligonucleotide
  Target: AGXT; (+) strand; PAM type: YTN; PAM sequence: TTG
ccagcctgaggctcagaaac

SEQ ID NO: 17464 - DNA, 20 bp, Artificial Sequence
  Description of Artificial Sequence: Synthetic oligonucleotide
  Target: AGXT; (+) strand; PAM type: YTN; PAM sequence: CTG
aggctcagaaaccccatcca

SEQ ID NO: 17465 - DNA, 20 bp, Artificial Sequence
  Description of Artificial Sequence: Synthetic oligonucleotide
  Target: AGXT; (+) strand; PAM type: YTN; PAM sequence: CTC
agaaaccccatccagcctgg

SEQ ID NO: 17466 - DNA, 20 bp, Artificial Sequence
  Description of Artificial Sequence: Synthetic oligonucleotide
  Target: AGXT; (+) strand; PAM type: YTN; PAM sequence: CTG
gggccaggccctccagtggc

SEQ ID NO: 17467 - DNA, 20 bp, Artificial Sequence
  Description of Artificial Sequence: Synthetic oligonucleotide
  Target: AGXT; (+) strand; PAM type: YTN; PAM sequence: CTC
cagtggccccctgcctcacc

SEQ ID NO: 17468 - DNA, 20 bp, Artificial Sequence
  Description of Artificial Sequence: Synthetic oligonucleotide
  Target: AGXT; (+) strand; PAM type: YTN; PAM sequence: CTG
cctcacctgctgccctccat

SEQ ID NO: 17469 - DNA, 20 bp, Artificial Sequence
  Description of Artificial Sequence: Synthetic oligonucleotide
  Target: AGXT; (+) strand; PAM type: YTN; PAM sequence: CTC
acctgctgccctccattctg

SEQ ID NO: 17470 - DNA, 20 bp, Artificial Sequence
  Description of Artificial Sequence: Synthetic oligonucleotide
  Target: AGXT; (+) strand; PAM type: YTN; PAM sequence: CTG
ctgccctccattctgtcccc

SEQ ID NO: 17471 - DNA, 20 bp, Artificial Sequence
  Description of Artificial Sequence: Synthetic oligonucleotide
  Target: AGXT; (+) strand; PAM type: YTN; PAM sequence: CTG
ccctccattctgtcccccac

SEQ ID NO: 17472 - DNA, 20 bp, Artificial Sequence
  Description of Artificial Sequence: Synthetic oligonucleotide
  Target: AGXT; (+) strand; PAM type: YTN; PAM sequence: CTC
cattctgtcccccacctctc

SEQ ID NO: 17473 - DNA, 20 bp, Artificial Sequence
  Description of Artificial Sequence: Synthetic oligonucleotide
  Target: AGXT; (+) strand; PAM type: YTN; PAM sequence: TTC
tgtcccccacctctccaggt

SEQ ID NO: 17474 - DNA, 20 bp, Artificial Sequence
  Description of Artificial Sequence: Synthetic oligonucleotide
  Target: AGXT; (+) strand; PAM type: YTN; PAM sequence: CTG
tcccccacctctccaggtac

SEQ ID NO: 17475 - DNA, 20 bp, Artificial Sequence
  Description of Artificial Sequence: Synthetic oligonucleotide
  Target: AGXT; (+) strand; PAM type: YTN; PAM sequence: CTC
tccaggtacaagtgcctgct

SEQ ID NO: 17476 - DNA, 20 bp, Artificial Sequence
  Description of Artificial Sequence: Synthetic oligonucleotide
  Target: AGXT; (+) strand; PAM type: YTN; PAM sequence: CTC
caggtacaagtgcctgctcc

SEQ ID NO: 17477 - DNA, 20 bp, Artificial Sequence
  Description of Artificial Sequence: Synthetic oligonucleotide
  Target: AGXT; (+) strand; PAM type: YTN; PAM sequence: CTG
ctcctggtggattcggtggc

SEQ ID NO: 17478 - DNA, 20 bp, Artificial Sequence
  Description of Artificial Sequence: Synthetic oligonucleotide
  Target: AGXT; (+) strand; PAM type: YTN; PAM sequence: CTC
ctggtggattcggtggcatc

SEQ ID NO: 17479 - DNA, 20 bp, Artificial Sequence
  Description of Artificial Sequence: Synthetic oligonucleotide
  Target: AGXT; (+) strand; PAM type: YTN; PAM sequence: CTG
gtggattcggtggcatccct

SEQ ID NO: 17480 - DNA, 20 bp, Artificial Sequence
  Description of Artificial Sequence: Synthetic oligonucleotide
  Target: AGXT; (+) strand; PAM type: YTN; PAM sequence: TTC
ggtggcatccctgggcggga

SEQ ID NO: 17481 - DNA, 20 bp, Artificial Sequence
  Description of Artificial Sequence: Synthetic oligonucleotide
  Target: AGXT; (+) strand; PAM type: YTN; PAM sequence: CTG
ggcgggacccccctttacat

SEQ ID NO: 17482 - DNA, 20 bp, Artificial Sequence
  Description of Artificial Sequence: Synthetic oligonucleotide
  Target: AGXT; (+) strand; PAM type: YTN; PAM sequence: CTT
tacatggaccggcaaggtaa

SEQ ID NO: 17483 - DNA, 20 bp, Artificial Sequence
  Description of Artificial Sequence: Synthetic oligonucleotide
  Target: AGXT; (+) strand; PAM type: YTN; PAM sequence: TTT
acatggaccggcaaggtaag

SEQ ID NO: 17484 - DNA, 20 bp, Artificial Sequence
  Description of Artificial Sequence: Synthetic oligonucleotide
  Target: AGXT; (+) strand; PAM type: YTN; PAM sequence: TTA
catggaccggcaaggtaagg

SEQ ID NO: 17485 - DNA, 20 bp, Artificial Sequence
  Description of Artificial Sequence: Synthetic oligonucleotide
  Target: AGXT; (+) strand; PAM type: YTN; PAM sequence: CTC
tgagagccctacccagccca

SEQ ID NO: 17486 - DNA, 20 bp, Artificial Sequence
  Description of Artificial Sequence: Synthetic oligonucleotide
  Target: AGXT; (+) strand; PAM type: YTN; PAM sequence: CTG
agagccctacccagcccaag

SEQ ID NO: 17487 - DNA, 20 bp, Artificial Sequence
  Description of Artificial Sequence: Synthetic oligonucleotide
  Target: AGXT; (+) strand; PAM type: YTN; PAM sequence: CTA
cccagcccaagcagccttgg

SEQ ID NO: 17488 - DNA, 20 bp, Artificial Sequence
  Description of Artificial Sequence: Synthetic oligonucleotide
  Target: AGXT; (+) strand; PAM type: YTN; PAM sequence: CTT
ggggctccgcgtgcaggaag

SEQ ID NO: 17489 - DNA, 20 bp, Artificial Sequence
  Description of Artificial Sequence: Synthetic oligonucleotide
  Target: AGXT; (+) strand; PAM type: YTN; PAM sequence: TTG
gggctccgcgtgcaggaagc

SEQ ID NO: 17490 - DNA, 20 bp, Artificial Sequence
  Description of Artificial Sequence: Synthetic oligonucleotide
  Target: AGXT; (+) strand; PAM type: YTN; PAM sequence: CTC
cgcgtgcaggaagccctgct

SEQ ID NO: 17491 - DNA, 20 bp, Artificial Sequence
  Description of Artificial Sequence: Synthetic oligonucleotide
  Target: AGXT; (+) strand; PAM type: YTN; PAM sequence: CTG
ctggaagcgtgcgtccagca

SEQ ID NO: 17492 - DNA, 20 bp, Artificial Sequence
  Description of Artificial Sequence: Synthetic oligonucleotide
  Target: AGXT; (+) strand; PAM type: YTN; PAM sequence: CTG
gaagcgtgcgtccagcagcc

SEQ ID NO: 17493 - DNA, 20 bp, Artificial Sequence
  Description of Artificial Sequence: Synthetic oligonucleotide
  Target: AGXT; (+) strand; PAM type: YTN; PAM sequence: CTG
cggattcggccccatctcca

SEQ ID NO: 17494 - DNA, 20 bp, Artificial Sequence
  Description of Artificial Sequence: Synthetic oligonucleotide
  Target: AGXT; (+) strand; PAM type: YTN; PAM sequence: TTC
ggccccatctccaccaggcc

SEQ ID NO: 17495 - DNA, 20 bp, Artificial Sequence
  Description of Artificial Sequence: Synthetic oligonucleotide
  Target: AGXT; (+) strand; PAM type: YTN; PAM sequence: CTC
caccaggcccagggaaacac

SEQ ID NO: 17496 - DNA, 20 bp, Artificial Sequence
  Description of Artificial Sequence: Synthetic oligonucleotide
  Target: AGXT; (+) strand; PAM type: YTN; PAM sequence: CTC
actccttactgcggcaagag

SEQ ID NO: 17497 - DNA, 20 bp, Artificial Sequence
  Description of Artificial Sequence: Synthetic oligonucleotide
  Target: AGXT; (+) strand; PAM type: YTN; PAM sequence: CTC
cttactgcggcaagagcggc

SEQ ID NO: 17498 - DNA, 20 bp, Artificial Sequence
  Description of Artificial Sequence: Synthetic oligonucleotide
  Target: AGXT; (+) strand; PAM type: YTN; PAM sequence: CTT
actgcggcaagagcggctcc

SEQ ID NO: 17499 - DNA, 20 bp, Artificial Sequence
  Description of Artificial Sequence: Synthetic oligonucleotide
  Target: AGXT; (+) strand; PAM type: YTN; PAM sequence: TTA
ctgcggcaagagcggctcca

SEQ ID NO: 17500 - DNA, 20 bp, Artificial Sequence
  Description of Artificial Sequence: Synthetic oligonucleotide
  Target: AGXT; (+) strand; PAM type: YTN; PAM sequence: CTG
cggcaagagcggctccatga

SEQ ID NO: 17501 - DNA, 20 bp, Artificial Sequence
  Description of Artificial Sequence: Synthetic oligonucleotide
  Target: AGXT; (+) strand; PAM type: YTN; PAM sequence: CTC
catgaactacccagcacccc

SEQ ID NO: 17502 - DNA, 20 bp, Artificial Sequence
  Description of Artificial Sequence: Synthetic oligonucleotide
  Target: AGXT; (+) strand; PAM type: YTN; PAM sequence: CTA
cccagcaccccagtgtttcc

SEQ ID NO: 17503 - DNA, 20 bp, Artificial Sequence
  Description of Artificial Sequence: Synthetic oligonucleotide
  Target: AGXT; (+) strand; PAM type: YTN; PAM sequence: TTT
ccactgagctttcagatcca

SEQ ID NO: 17504 - DNA, 20 bp, Artificial Sequence
  Description of Artificial Sequence: Synthetic oligonucleotide
  Target: AGXT; (+) strand; PAM type: YTN; PAM sequence: TTC
cactgagctttcagatccag

SEQ ID NO: 17505 - DNA, 20 bp, Artificial Sequence
  Description of Artificial Sequence: Synthetic oligonucleotide
  Target: AGXT; (+) strand; PAM type: YTN; PAM sequence: CTG
agctttcagatccaggcgtg

SEQ ID NO: 17506 - DNA, 20 bp, Artificial Sequence
  Description of Artificial Sequence: Synthetic oligonucleotide
  Target: AGXT; (+) strand; PAM type: YTN; PAM sequence: CTT
tcagatccaggcgtggggac

SEQ ID NO: 17507 - DNA, 20 bp, Artificial Sequence
  Description of Artificial Sequence: Synthetic oligonucleotide
  Target: AGXT; (+) strand; PAM type: YTN; PAM sequence: TTT
cagatccaggcgtggggact

SEQ ID NO: 17508 - DNA, 20 bp, Artificial Sequence
  Description of Artificial Sequence: Synthetic oligonucleotide
  Target: AGXT; (+) strand; PAM type: YTN; PAM sequence: TTC
agatccaggcgtggggactg

SEQ ID NO: 17509 - DNA, 20 bp, Artificial Sequence
  Description of Artificial Sequence: Synthetic oligonucleotide
  Target: AGXT; (+) strand; PAM type: YTN; PAM sequence: CTG
gcaggagggacagcttctgg

SEQ ID NO: 17510 - DNA, 20 bp, Artificial Sequence
  Description of Artificial Sequence: Synthetic oligonucleotide
  Target: AGXT; (+) strand; PAM type: YTN; PAM sequence: CTT
ctggtgggggacatttgaga

SEQ ID NO: 17511 - DNA, 20 bp, Artificial Sequence
  Description of Artificial Sequence: Synthetic oligonucleotide
  Target: AGXT; (+) strand; PAM type: YTN; PAM sequence: TTC
tggtgggggacatttgagat

SEQ ID NO: 17512 - DNA, 20 bp, Artificial Sequence
  Description of Artificial Sequence: Synthetic oligonucleotide
  Target: AGXT; (+) strand; PAM type: YTN; PAM sequence: CTG
gtgggggacatttgagatgc

SEQ ID NO: 17513 - DNA, 20 bp, Artificial Sequence
  Description of Artificial Sequence: Synthetic oligonucleotide
  Target: AGXT; (+) strand; PAM type: YTN; PAM sequence: TTT
gagatgccccagagctgtag

SEQ ID NO: 17514 - DNA, 20 bp, Artificial Sequence
  Description of Artificial Sequence: Synthetic oligonucleotide
  Target: AGXT; (+) strand; PAM type: YTN; PAM sequence: TTG
agatgccccagagctgtagc

SEQ ID NO: 17515 - DNA, 20 bp, Artificial Sequence
  Description of Artificial Sequence: Synthetic oligonucleotide
  Target: AGXT; (+) strand; PAM type: YTN; PAM sequence: CTG
tagcagaagcagtgggaaga

SEQ ID NO: 17516 - DNA, 20 bp, Artificial Sequence
  Description of Artificial Sequence: Synthetic oligonucleotide
  Target: AGXT; (+) strand; PAM type: YTN; PAM sequence: CTC
cagtcaatcaggcgttgggc

SEQ ID NO: 17517 - DNA, 20 bp, Artificial Sequence
  Description of Artificial Sequence: Synthetic oligonucleotide
  Target: AGXT; (+) strand; PAM type: YTN; PAM sequence: TTG
ggcacccctctgcccaaccc

SEQ ID NO: 17518 - DNA, 20 bp, Artificial Sequence
  Description of Artificial Sequence: Synthetic oligonucleotide
  Target: AGXT; (+) strand; PAM type: YTN; PAM sequence: CTC
tgcccaaccccccagaggct

SEQ ID NO: 17519 - DNA, 20 bp, Artificial Sequence
  Description of Artificial Sequence: Synthetic oligonucleotide
  Target: AGXT; (+) strand; PAM type: YTN; PAM sequence: CTG
cccaaccccccagaggctca

SEQ ID NO: 17520 - DNA, 20 bp, Artificial Sequence
  Description of Artificial Sequence: Synthetic oligonucleotide
  Target: AGXT; (+) strand; PAM type: YTN; PAM sequence: CTC
agtttcacatctgccctgcg

SEQ ID NO: 17521 - DNA, 20 bp, Artificial Sequence
  Description of Artificial Sequence: Synthetic oligonucleotide
  Target: AGXT; (+) strand; PAM type: YTN; PAM sequence: TTT
cacatctgccctgcgccctg

SEQ ID NO: 17522 - DNA, 20 bp, Artificial Sequence
  Description of Artificial Sequence: Synthetic oligonucleotide
  Target: AGXT; (+) strand; PAM type: YTN; PAM sequence: TTC
acatctgccctgcgccctgc

SEQ ID NO: 17523 - DNA, 20 bp, Artificial Sequence
  Description of Artificial Sequence: Synthetic oligonucleotide
  Target: AGXT; (+) strand; PAM type: YTN; PAM sequence: CTG
ccctgcgccctgccaggctg

SEQ ID NO: 17524 - DNA, 20 bp, Artificial Sequence
  Description of Artificial Sequence: Synthetic oligonucleotide
  Target: AGXT; (+) strand; PAM type: YTN; PAM sequence: CTG
cgccctgccaggctgcccat

SEQ ID NO: 17525 - DNA, 20 bp, Artificial Sequence
  Description of Artificial Sequence: Synthetic oligonucleotide
  Target: AGXT; (+) strand; PAM type: YTN; PAM sequence: CTG
ccaggctgcccatagcagtg

SEQ ID NO: 17526 - DNA, 20 bp, Artificial Sequence
  Description of Artificial Sequence: Synthetic oligonucleotide
  Target: AGXT; (+) strand; PAM type: YTN; PAM sequence: CTG
cccatagcagtgagcaccac

SEQ ID NO: 17527 - DNA, 20 bp, Artificial Sequence
  Description of Artificial Sequence: Synthetic oligonucleotide
  Target: AGXT; (+) strand; PAM type: YTN; PAM sequence: CTG
tcagggtcacctcgcaggga

SEQ ID NO: 17528 - DNA, 20 bp, Artificial Sequence
  Description of Artificial Sequence: Synthetic oligonucleotide
  Target: AGXT; (+) strand; PAM type: YTN; PAM sequence: CTC
gcagggaacctcaaccaggc

SEQ ID NO: 17529 - DNA, 20 bp, Artificial Sequence
  Description of Artificial Sequence: Synthetic oligonucleotide
  Target: AGXT; (+) strand; PAM type: YTN; PAM sequence: CTC
aaccaggccggccgaggggc

SEQ ID NO: 17530 - DNA, 20 bp, Artificial Sequence
  Description of Artificial Sequence: Synthetic oligonucleotide
  Target: AGXT; (+) strand; PAM type: YTN; PAM sequence: CTC
ctgtgcccatccgcttacgg

SEQ ID NO: 17531 - DNA, 20 bp, Artificial Sequence
  Description of Artificial Sequence: Synthetic oligonucleotide
  Target: AGXT; (+) strand; PAM type: YTN; PAM sequence: CTG
tgcccatccgcttacgggag

SEQ ID NO: 17532 - DNA, 20 bp, Artificial Sequence
  Description of Artificial Sequence: Synthetic oligonucleotide
  Target: AGXT; (+) strand; PAM type: YTN; PAM sequence: CTT
acgggagagagcctgcacat

SEQ ID NO: 17533 - DNA, 20 bp, Artificial Sequence
  Description of Artificial Sequence: Synthetic oligonucleotide
  Target: AGXT; (+) strand; PAM type: YTN; PAM sequence: TTA
cgggagagagcctgcacatt

SEQ ID NO: 17534 - DNA, 20 bp, Artificial Sequence
  Description of Artificial Sequence: Synthetic oligonucleotide
  Target: AGXT; (+) strand; PAM type: YTN; PAM sequence: CTG
cacattgcatccactgcggt

SEQ ID NO: 17535 - DNA, 20 bp, Artificial Sequence
  Description of Artificial Sequence: Synthetic oligonucleotide
  Target: AGXT; (+) strand; PAM type: YTN; PAM sequence: TTG
catccactgcggtgcctgcc

SEQ ID NO: 17536 - DNA, 20 bp, Artificial Sequence
  Description of Artificial Sequence: Synthetic oligonucleotide
  Target: AGXT; (+) strand; PAM type: YTN; PAM sequence: CTG
cggtgcctgcccacccactc

SEQ ID NO: 17537 - DNA, 20 bp, Artificial Sequence
  Description of Artificial Sequence: Synthetic oligonucleotide
  Target: AGXT; (+) strand; PAM type: YTN; PAM sequence: CTG
cccacccactccatgggagc

SEQ ID NO: 17538 - DNA, 20 bp, Artificial Sequence
  Description of Artificial Sequence: Synthetic oligonucleotide
  Target: AGXT; (+) strand; PAM type: YTN; PAM sequence: CTC
catgggagcctgtctgtttc

SEQ ID NO: 17539 - DNA, 20 bp, Artificial Sequence
  Description of Artificial Sequence: Synthetic oligonucleotide
  Target: AGXT; (+) strand; PAM type: YTN; PAM sequence: CTG
tctgtttctgcagagcccct

SEQ ID NO: 17540 - DNA, 20 bp, Artificial Sequence
  Description of Artificial Sequence: Synthetic oligonucleotide
  Target: AGXT; (+) strand; PAM type: YTN; PAM sequence: CTG
tttctgcagagcccctcctg

SEQ ID NO: 17541 - DNA, 20 bp, Artificial Sequence
  Description of Artificial Sequence: Synthetic oligonucleotide
  Target: AGXT; (+) strand; PAM type: YTN; PAM sequence: TTT
ctgcagagcccctcctgatt

SEQ ID NO: 17542 - DNA, 20 bp, Artificial Sequence
  Description of Artificial Sequence: Synthetic oligonucleotide
  Target: AGXT; (+) strand; PAM type: YTN; PAM sequence: TTC
tgcagagcccctcctgattt

SEQ ID NO: 17543 - DNA, 20 bp, Artificial Sequence
  Description of Artificial Sequence: Synthetic oligonucleotide
  Target: AGXT; (+) strand; PAM type: YTN; PAM sequence: CTG
cagagcccctcctgatttgg

SEQ ID NO: 17544 - DNA, 20 bp, Artificial Sequence
  Description of Artificial Sequence: Synthetic oligonucleotide
  Target: AGXT; (+) strand; PAM type: YTN; PAM sequence: CTC
ctgatttgggagttctcagg

SEQ ID NO: 17545 - DNA, 20 bp, Artificial Sequence
  Description of Artificial Sequence: Synthetic oligonucleotide
  Target: AGXT; (+) strand; PAM type: YTN; PAM sequence: CTG
atttgggagttctcaggcag

SEQ ID NO: 17546 - DNA, 20 bp, Artificial Sequence
  Description of Artificial Sequence: Synthetic oligonucleotide
  Target: AGXT; (+) strand; PAM type: YTN; PAM sequence: TTT
gggagttctcaggcaggaag

SEQ ID NO: 17547 - DNA, 20 bp, Artificial Sequence
  Description of Artificial Sequence: Synthetic oligonucleotide
  Target: AGXT; (+) strand; PAM type: YTN; PAM sequence: TTG
ggagttctcaggcaggaagg

SEQ ID NO: 17548 - DNA, 20 bp, Artificial Sequence
  Description of Artificial Sequence: Synthetic oligonucleotide
  Target: AGXT; (+) strand; PAM type: YTN; PAM sequence: TTC
tcaggcaggaagggagggat

SEQ ID NO: 17549 - DNA, 20 bp, Artificial Sequence
  Description of Artificial Sequence: Synthetic oligonucleotide
  Target: AGXT; (+) strand; PAM type: YTN; PAM sequence: CTC
aggcaggaagggagggattt

SEQ ID NO: 17550 - DNA, 20 bp, Artificial Sequence
  Description of Artificial Sequence: Synthetic oligonucleotide
  Target: AGXT; (+) strand; PAM type: YTN; PAM sequence: TTT
ctgggctgatcctcaaacta

SEQ ID NO: 17551 - DNA, 20 bp, Artificial Sequence
  Description of Artificial Sequence: Synthetic oligonucleotide
  Target: AGXT; (+) strand; PAM type: YTN; PAM sequence: TTC
tgggctgatcctcaaactac

SEQ ID NO: 17552 - DNA, 20 bp, Artificial Sequence
  Description of Artificial Sequence: Synthetic oligonucleotide
  Target: AGXT; (+) strand; PAM type: YTN; PAM sequence: CTG
ggctgatcctcaaactacta

SEQ ID NO: 17553 - DNA, 20 bp, Artificial Sequence
  Description of Artificial Sequence: Synthetic oligonucleotide
  Target: AGXT; (+) strand; PAM type: YTN; PAM sequence: CTG
atcctcaaactactactgaa

SEQ ID NO: 17554 - DNA, 20 bp, Artificial Sequence
  Description of Artificial Sequence: Synthetic oligonucleotide
  Target: AGXT; (+) strand; PAM type: YTN; PAM sequence: CTC
aaactactactgaaagcagg

SEQ ID NO: 17555 - DNA, 20 bp, Artificial Sequence
  Description of Artificial Sequence: Synthetic oligonucleotide
  Target: AGXT; (+) strand; PAM type: YTN; PAM sequence: CTA
ctactgaaagcagggacctg

SEQ ID NO: 17556 - DNA, 20 bp, Artificial Sequence
  Description of Artificial Sequence: Synthetic oligonucleotide
  Target: AGXT; (+) strand; PAM type: YTN; PAM sequence: CTA
ctgaaagcagggacctgggg

SEQ ID NO: 17557 - DNA, 20 bp, Artificial Sequence
  Description of Artificial Sequence: Synthetic oligonucleotide
  Target: AGXT; (+) strand; PAM type: YTN; PAM sequence: CTG
aaagcagggacctggggagg

SEQ ID NO: 17558 - DNA, 20 bp, Artificial Sequence
  Description of Artificial Sequence: Synthetic oligonucleotide
  Target: AGXT; (+) strand; PAM type: YTN; PAM sequence: CTG
gggagggccccagggacacg

SEQ ID NO: 17559 - DNA, 20 bp, Artificial Sequence
  Description of Artificial Sequence: Synthetic oligonucleotide
  Target: AGXT; (+) strand; PAM type: YTN; PAM sequence: CTG
gggtggcagggctgtccctg

SEQ ID NO: 17560 - DNA, 20 bp, Artificial Sequence
  Description of Artificial Sequence: Synthetic oligonucleotide
  Target: AGXT; (+) strand; PAM type: YTN; PAM sequence: CTG
tccctggggaccagcacagc

SEQ ID NO: 17561 - DNA, 20 bp, Artificial Sequence
  Description of Artificial Sequence: Synthetic oligonucleotide
  Target: AGXT; (+) strand; PAM type: YTN; PAM sequence: CTG
gggaccagcacagcagaggg

SEQ ID NO: 17562 - DNA, 20 bp, Artificial Sequence
  Description of Artificial Sequence: Synthetic oligonucleotide
  Target: AGXT; (+) strand; PAM type: YTN; PAM sequence: CTG
cgctaaaacgctcaggcctg

SEQ ID NO: 17563 - DNA, 20 bp, Artificial Sequence
  Description of Artificial Sequence: Synthetic oligonucleotide
  Target: AGXT; (+) strand; PAM type: YTN; PAM sequence: CTA
aaacgctcaggcctgaggtc

SEQ ID NO: 17564 - DNA, 20 bp, Artificial Sequence
  Description of Artificial Sequence: Synthetic oligonucleotide
  Target: AGXT; (+) strand; PAM type: YTN; PAM sequence: CTC
aggcctgaggtcatggctgc

SEQ ID NO: 17565 - DNA, 20 bp, Artificial Sequence
  Description of Artificial Sequence: Synthetic oligonucleotide
  Target: AGXT; (+) strand; PAM type: YTN; PAM sequence: CTG
aggtcatggctgccacgcag

SEQ ID NO: 17566 - DNA, 20 bp, Artificial Sequence
  Description of Artificial Sequence: Synthetic oligonucleotide
  Target: AGXT; (+) strand; PAM type: YTN; PAM sequence: CTG
ccacgcagcagtgcccagat

SEQ ID NO: 17567 - DNA, 20 bp, Artificial Sequence
  Description of Artificial Sequence: Synthetic oligonucleotide
  Target: AGXT; (+) strand; PAM type: YTN; PAM sequence: TTT
gaacccaggactcccttcca

SEQ ID NO: 17568 - DNA, 20 bp, Artificial Sequence
  Description of Artificial Sequence: Synthetic oligonucleotide
  Target: AGXT; (+) strand; PAM type: YTN; PAM sequence: TTG
aacccaggactcccttccac

SEQ ID NO: 17569 - DNA, 20 bp, Artificial Sequence
  Description of Artificial Sequence: Synthetic oligonucleotide
  Target: AGXT; (+) strand; PAM type: YTN; PAM sequence: CTC
ccttccacatctcccctgct

SEQ ID NO: 17570 - DNA, 20 bp, Artificial Sequence
  Description of Artificial Sequence: Synthetic oligonucleotide
  Target: AGXT; (+) strand; PAM type: YTN; PAM sequence: CTT
ccacatctcccctgctatcg

SEQ ID NO: 17571 - DNA, 20 bp, Artificial Sequence
  Description of Artificial Sequence: Synthetic oligonucleotide
  Target: AGXT; (+) strand; PAM type: YTN; PAM sequence: TTC
cacatctcccctgctatcgt

SEQ ID NO: 17572 - DNA, 20 bp, Artificial Sequence
  Description of Artificial Sequence: Synthetic oligonucleotide
  Target: AGXT; (+) strand; PAM type: YTN; PAM sequence: CTC
ccctgctatcgtgtacggat

SEQ ID NO: 17573 - DNA, 20 bp, Artificial Sequence
  Description of Artificial Sequence: Synthetic oligonucleotide
  Target: AGXT; (+) strand; PAM type: YTN; PAM sequence: CTG
ctatcgtgtacggattcgtg

SEQ ID NO: 17574 - DNA, 20 bp, Artificial Sequence
  Description of Artificial Sequence: Synthetic oligonucleotide
  Target: AGXT; (+) strand; PAM type: YTN; PAM sequence: CTA
tcgtgtacggattcgtggta

SEQ ID NO: 17575 - DNA, 20 bp, Artificial Sequence
  Description of Artificial Sequence: Synthetic oligonucleotide
  Target: AGXT; (+) strand; PAM type: YTN; PAM sequence: TTC
gtggtagggtcgtagcctac

SEQ ID NO: 17576 - DNA, 20 bp, Artificial Sequence
  Description of Artificial Sequence: Synthetic oligonucleotide
  Target: AGXT; (+) strand; PAM type: YTN; PAM sequence: CTA
ccagcccattagctaggcag

SEQ ID NO: 17577 - DNA, 20 bp, Artificial Sequence
  Description of Artificial Sequence: Synthetic oligonucleotide
  Target: AGXT; (+) strand; PAM type: YTN; PAM sequence: TTA
gctaggcaggcatcccgctg

SEQ ID NO: 17578 - DNA, 20 bp, Artificial Sequence
  Description of Artificial Sequence: Synthetic oligonucleotide
  Target: AGXT; (+) strand; PAM type: YTN; PAM sequence: CTA
ggcaggcatcccgctggact

SEQ ID NO: 17579 - DNA, 20 bp, Artificial Sequence
  Description of Artificial Sequence: Synthetic oligonucleotide
  Target: AGXT; (+) strand; PAM type: YTN; PAM sequence: CTG
gactggcctgccctgaggtg

SEQ ID NO: 17580 - DNA, 20 bp, Artificial Sequence
  Description of Artificial Sequence: Synthetic oligonucleotide
  Target: AGXT; (+) strand; PAM type: YTN; PAM sequence: CTG
gcctgccctgaggtgggact

SEQ ID NO: 17581 - DNA, 20 bp, Artificial Sequence
  Description of Artificial Sequence: Synthetic oligonucleotide
  Target: AGXT; (+) strand; PAM type: YTN; PAM sequence: CTG
ccctgaggtgggactcaccc

SEQ ID NO: 17582 - DNA, 20 bp, Artificial Sequence
  Description of Artificial Sequence: Synthetic oligonucleotide
  Target: AGXT; (+) strand; PAM type: YTN; PAM sequence: CTG
aggtgggactcacccgtccc

SEQ ID NO: 17583 - DNA, 20 bp, Artificial Sequence
  Description of Artificial Sequence: Synthetic oligonucleotide
  Target: AGXT; (+) strand; PAM type: YTN; PAM sequence: CTC
acccgtcccgagcaaaccac

SEQ ID NO: 17584 - DNA, 20 bp, Artificial Sequence
  Description of Artificial Sequence: Synthetic oligonucleotide
  Target: AGXT; (+) strand; PAM type: YTN; PAM sequence: CTA
caggcatcgacatcctgtac

SEQ ID NO: 17585 - DNA, 20 bp, Artificial Sequence
  Description of Artificial Sequence: Synthetic oligonucleotide
  Target: AGXT; (+) strand; PAM type: YTN; PAM sequence: CTG
tactcgggctcccagaaggc

SEQ ID NO: 17586 - DNA, 20 bp, Artificial Sequence
  Description of Artificial Sequence: Synthetic oligonucleotide
  Target: AGXT; (+) strand; PAM type: YTN; PAM sequence: CTC
gggctcccagaaggccctga

SEQ ID NO: 17587 - DNA, 20 bp, Artificial Sequence
  Description of Artificial Sequence: Synthetic oligonucleotide
  Target: AGXT; (+) strand; PAM type: YTN; PAM sequence: CTC
ccagaaggccctgaacgccc

SEQ ID NO: 17588 - DNA, 20 bp, Artificial Sequence
  Description of Artificial Sequence: Synthetic oligonucleotide
  Target: AGXT; (+) strand; PAM type: YTN; PAM sequence: CTG
aacgcccctccagggacctc

SEQ ID NO: 17589 - DNA, 20 bp, Artificial Sequence
  Description of Artificial Sequence: Synthetic oligonucleotide
  Target: AGXT; (+) strand; PAM type: YTN; PAM sequence: CTC
cagggacctcgctcatctcc

SEQ ID NO: 17590 - DNA, 20 bp, Artificial Sequence
  Description of Artificial Sequence: Synthetic oligonucleotide
  Target: AGXT; (+) strand; PAM type: YTN; PAM sequence: CTC
gctcatctccttcagtgaca

SEQ ID NO: 17591 - DNA, 20 bp, Artificial Sequence
  Description of Artificial Sequence: Synthetic oligonucleotide
  Target: AGXT; (+) strand; PAM type: YTN; PAM sequence: CTC
atctccttcagtgacaaggc

SEQ ID NO: 17592 - DNA, 20 bp, Artificial Sequence
  Description of Artificial Sequence: Synthetic oligonucleotide
  Target: AGXT; (+) strand; PAM type: YTN; PAM sequence: CTC
cttcagtgacaaggccaagt

SEQ ID NO: 17593 - DNA, 20 bp, Artificial Sequence
  Description of Artificial Sequence: Synthetic oligonucleotide
  Target: AGXT; (+) strand; PAM type: YTN; PAM sequence: CTT
cagtgacaaggccaagtgag

SEQ ID NO: 17594 - DNA, 20 bp, Artificial Sequence
  Description of Artificial Sequence: Synthetic oligonucleotide
  Target: AGXT; (+) strand; PAM type: YTN; PAM sequence: TTC
agtgacaaggccaagtgagt

SEQ ID NO: 17595 - DNA, 20 bp, Artificial Sequence
  Description of Artificial Sequence: Synthetic oligonucleotide
  Target: AGXT; (+) strand; PAM type: YTN; PAM sequence: CTC
acctctgtgcagggctgggc

SEQ ID NO: 17596 - DNA, 20 bp, Artificial Sequence
  Description of Artificial Sequence: Synthetic oligonucleotide
  Target: AGXT; (+) strand; PAM type: YTN; PAM sequence: CTC
tgtgcagggctgggcttgca

SEQ ID NO: 17597 - DNA, 20 bp, Artificial Sequence
  Description of Artificial Sequence: Synthetic oligonucleotide
  Target: AGXT; (+) strand; PAM type: YTN; PAM sequence: CTG
tgcagggctgggcttgcagg

SEQ ID NO: 17598 - DNA, 20 bp, Artificial Sequence
  Description of Artificial Sequence: Synthetic oligonucleotide
  Target: AGXT; (+) strand; PAM type: YTN; PAM sequence: CTG
ggcttgcagggagctcaggt

SEQ ID NO: 17599 - DNA, 20 bp, Artificial Sequence
  Description of Artificial Sequence: Synthetic oligonucleotide
  Target: AGXT; (+) strand; PAM type: YTN; PAM sequence: CTT
gcagggagctcaggtggccc

SEQ ID NO: 17600 - DNA, 20 bp, Artificial Sequence
  Description of Artificial Sequence: Synthetic oligonucleotide
  Target: AGXT; (+) strand; PAM type: YTN; PAM sequence: TTG
cagggagctcaggtggcccg

SEQ ID NO: 17601 - DNA, 20 bp, Artificial Sequence
  Description of Artificial Sequence: Synthetic oligonucleotide
  Target: AGXT; (+) strand; PAM type: YTN; PAM sequence: CTC
aggtggcccgaggcgggagg

SEQ ID NO: 17602 - DNA, 20 bp, Artificial Sequence
  Description of Artificial Sequence: Synthetic oligonucleotide
  Target: AGXT; (+) strand; PAM type: YTN; PAM sequence: CTC
cccatgctcctccagcacct

SEQ ID NO: 17603 - DNA, 20 bp, Artificial Sequence
  Description of Artificial Sequence: Synthetic oligonucleotide
  Target: AGXT; (+) strand; PAM type: YTN; PAM sequence: CTC
ctccagcacctggcgctctc

SEQ ID NO: 17604 - DNA, 20 bp, Artificial Sequence
  Description of Artificial Sequence: Synthetic oligonucleotide
  Target: AGXT; (+) strand; PAM type: YTN; PAM sequence: CTC
cagcacctggcgctctcccg

SEQ ID NO: 17605 - DNA, 20 bp, Artificial Sequence
  Description of Artificial Sequence: Synthetic oligonucleotide
  Target: AGXT; (+) strand; PAM type: YTN; PAM sequence: CTG
gcgctctcccgcccaccctc

SEQ ID NO: 17606 - DNA, 20 bp, Artificial Sequence
  Description of Artificial Sequence: Synthetic oligonucleotide
  Target: AGXT; (+) strand; PAM type: YTN; PAM sequence: CTC
tcccgcccaccctctgggag

SEQ ID NO: 17607 - DNA, 20 bp, Artificial Sequence
  Description of Artificial Sequence: Synthetic oligonucleotide
  Target: AGXT; (+) strand; PAM type: YTN; PAM sequence: CTC
ccgcccaccctctgggaggc

SEQ ID NO: 17608 - DNA, 20 bp, Artificial Sequence
  Description of Artificial Sequence: Synthetic oligonucleotide
  Target: AGXT; (+) strand; PAM type: YTN; PAM sequence: CTC
tgggaggccaaaggcactgc

SEQ ID NO: 17609 - DNA, 20 bp, Artificial Sequence
  Description of Artificial Sequence: Synthetic oligonucleotide
  Target: AGXT; (+) strand; PAM type: YTN; PAM sequence: CTG
ggaggccaaaggcactgcgt

SEQ ID NO: 17610 - DNA, 20 bp, Artificial Sequence
  Description of Artificial Sequence: Synthetic oligonucleotide
  Target: AGXT; (+) strand; PAM type: YTN; PAM sequence: CTG
cgttcacagggagtggggag

SEQ ID NO: 17611 - DNA, 20 bp, Artificial Sequence
  Description of Artificial Sequence: Synthetic oligonucleotide
  Target: AGXT; (+) strand; PAM type: YTN; PAM sequence: TTC
acagggagtggggaggccgg

SEQ ID NO: 17612 - DNA, 20 bp, Artificial Sequence
  Description of Artificial Sequence: Synthetic oligonucleotide
  Target: AGXT; (+) strand; PAM type: YTN; PAM sequence: CTG
caggcgtgtgcagggtgcag

SEQ ID NO: 17613 - DNA, 20 bp, Artificial Sequence
  Description of Artificial Sequence: Synthetic oligonucleotide
  Target: AGXT; (+) strand; PAM type: YTN; PAM sequence: CTG
ctctggaagttcccagcttc

SEQ ID NO: 17614 - DNA, 20 bp, Artificial Sequence
  Description of Artificial Sequence: Synthetic oligonucleotide
  Target: AGXT; (+) strand; PAM type: YTN; PAM sequence: CTC
tggaagttcccagcttcaca

SEQ ID NO: 17615 - DNA, 20 bp, Artificial Sequence
  Description of Artificial Sequence: Synthetic oligonucleotide
  Target: AGXT; (+) strand; PAM type: YTN; PAM sequence: CTG
gaagttcccagcttcacagc

SEQ ID NO: 17616 - DNA, 20 bp, Artificial Sequence
  Description of Artificial Sequence: Synthetic oligonucleotide
  Target: AGXT; (+) strand; PAM type: YTN; PAM sequence: TTC
ccagcttcacagcaaggagt

SEQ ID NO: 17617 - DNA, 20 bp, Artificial Sequence
  Description of Artificial Sequence: Synthetic oligonucleotide
  Target: AGXT; (+) strand; PAM type: YTN; PAM sequence: CTT
cacagcaaggagtgaccagg

SEQ ID NO: 17618 - DNA, 20 bp, Artificial Sequence
  Description of Artificial Sequence: Synthetic oligonucleotide
  Target: AGXT; (+) strand; PAM type: YTN; PAM sequence: TTC
acagcaaggagtgaccagga

SEQ ID NO: 17619 - DNA, 20 bp, Artificial Sequence
  Description of Artificial Sequence: Synthetic oligonucleotide
  Target: AGXT; (+) strand; PAM type: YTN; PAM sequence: CTG
agggcctgaggcccagtgcc

SEQ ID NO: 17620 - DNA, 20 bp, Artificial Sequence
  Description of Artificial Sequence: Synthetic oligonucleotide
  Target: AGXT; (+) strand; PAM type: YTN; PAM sequence: CTG
aggcccagtgccctgaccgg

SEQ ID NO: 17621 - DNA, 20 bp, Artificial Sequence
  Description of Artificial Sequence: Synthetic oligonucleotide
  Target: AGXT; (+) strand; PAM type: YTN; PAM sequence: CTG
accggcctctgccctggctc

SEQ ID NO: 17622 - DNA, 20 bp, Artificial Sequence
  Description of Artificial Sequence: Synthetic oligonucleotide
  Target: AGXT; (+) strand; PAM type: YTN; PAM sequence: CTC
tgccctggctcagcttccag

SEQ ID NO: 17623 - DNA, 20 bp, Artificial Sequence
  Description of Artificial Sequence: Synthetic oligonucleotide
  Target: AGXT; (+) strand; PAM type: YTN; PAM sequence: CTG
ccctggctcagcttccaggg

SEQ ID NO: 17624 - DNA, 20 bp, Artificial Sequence
  Description of Artificial Sequence: Synthetic oligonucleotide
  Target: AGXT; (+) strand; PAM type: YTN; PAM sequence: CTG
gctcagcttccaggggctgc

SEQ ID NO: 17625 - DNA, 20 bp, Artificial Sequence
  Description of Artificial Sequence: Synthetic oligonucleotide
  Target: AGXT; (+) strand; PAM type: YTN; PAM sequence: CTC
agcttccaggggctgcccca

SEQ ID NO: 17626 - DNA, 20 bp, Artificial Sequence
  Description of Artificial Sequence: Synthetic oligonucleotide
  Target: AGXT; (+) strand; PAM type: YTN; PAM sequence: CTT
ccaggggctgccccaaggga

SEQ ID NO: 17627 - DNA, 20 bp, Artificial Sequence
  Description of Artificial Sequence: Synthetic oligonucleotide
  Target: AGXT; (+) strand; PAM type: YTN; PAM sequence: TTC
caggggctgccccaagggac

SEQ ID NO: 17628 - DNA, 20 bp, Artificial Sequence
  Description of Artificial Sequence: Synthetic oligonucleotide
  Target: AGXT; (+) strand; PAM type: YTN; PAM sequence: CTG
ccccaagggacaacgtgggc

SEQ ID NO: 17629 - DNA, 20 bp, Artificial Sequence
  Description of Artificial Sequence: Synthetic oligonucleotide
  Target: AGXT; (+) strand; PAM type: YTN; PAM sequence: CTG
cagtcccaatctcacctccc

SEQ ID NO: 17630 - DNA, 20 bp, Artificial Sequence
  Description of Artificial Sequence: Synthetic oligonucleotide
  Target: AGXT; (+) strand; PAM type: YTN; PAM sequence: CTC
acctcccgctcctggtgtcc

SEQ ID NO: 17631 - DNA, 20 bp, Artificial Sequence
  Description of Artificial Sequence: Synthetic oligonucleotide
  Target: AGXT; (+) strand; PAM type: YTN; PAM sequence: CTC
ccgctcctggtgtccagatt

SEQ ID NO: 17632 - DNA, 20 bp, Artificial Sequence
  Description of Artificial Sequence: Synthetic oligonucleotide
  Target: AGXT; (+) strand; PAM type: YTN; PAM sequence: CTC
ctggtgtccagattctgagc

SEQ ID NO: 17633 - DNA, 20 bp, Artificial Sequence
  Description of Artificial Sequence: Synthetic oligonucleotide
  Target: AGXT; (+) strand; PAM type: YTN; PAM sequence: CTG
gtgtccagattctgagccag

SEQ ID NO: 17634 - DNA, 20 bp, Artificial Sequence
  Description of Artificial Sequence: Synthetic oligonucleotide
  Target: AGXT; (+) strand; PAM type: YTN; PAM sequence: TTC
tgagccaggccgggcagggg

SEQ ID NO: 17635 - DNA, 20 bp, Artificial Sequence
  Description of Artificial Sequence: Synthetic oligonucleotide
  Target: AGXT; (+) strand; PAM type: YTN; PAM sequence: CTG
agccaggccgggcagggggt

SEQ ID NO: 17636 - DNA, 20 bp, Artificial Sequence
  Description of Artificial Sequence: Synthetic oligonucleotide
  Target: AGXT; (+) strand; PAM type: YTN; PAM sequence: CTC
acaggcggttcccatccagc

SEQ ID NO: 17637 - DNA, 20 bp, Artificial Sequence
  Description of Artificial Sequence: Synthetic oligonucleotide
  Target: AGXT; (+) strand; PAM type: YTN; PAM sequence: TTC
ccatccagctgcagcctggc

SEQ ID NO: 17638 - DNA, 20 bp, Artificial Sequence
  Description of Artificial Sequence: Synthetic oligonucleotide
  Target: AGXT; (+) strand; PAM type: YTN; PAM sequence: CTG
cagcctggcaactggaggtg

SEQ ID NO: 17639 - DNA, 20 bp, Artificial Sequence
  Description of Artificial Sequence: Synthetic oligonucleotide
  Target: AGXT; (+) strand; PAM type: YTN; PAM sequence: CTG
gcaactggaggtgccgttcc

SEQ ID NO: 17640 - DNA, 20 bp, Artificial Sequence
  Description of Artificial Sequence: Synthetic oligonucleotide
  Target: AGXT; (+) strand; PAM type: YTN; PAM sequence: CTG
gaggtgccgttccccagaac

SEQ ID NO: 17641 - DNA, 20 bp, Artificial Sequence
  Description of Artificial Sequence: Synthetic oligonucleotide
  Target: AGXT; (+) strand; PAM type: YTN; PAM sequence: TTC
cccagaacagagaggacttc

SEQ ID NO: 17642 - DNA, 20 bp, Artificial Sequence
  Description of Artificial Sequence: Synthetic oligonucleotide
  Target: AGXT; (+) strand; PAM type: YTN; PAM sequence: CTT
cggggagaagtcaggaattc

SEQ ID NO: 17643 - DNA, 20 bp, Artificial Sequence
  Description of Artificial Sequence: Synthetic oligonucleotide
  Target: AGXT; (+) strand; PAM type: YTN; PAM sequence: TTC
ggggagaagtcaggaattcg

SEQ ID NO: 17644 - DNA, 20 bp, Artificial Sequence
  Description of Artificial Sequence: Synthetic oligonucleotide
  Target: AGXT; (+) strand; PAM type: YTN; PAM sequence: TTC
ggtgttggacgtgggaggtc

SEQ ID NO: 17645 - DNA, 20 bp, Artificial Sequence
  Description of Artificial Sequence: Synthetic oligonucleotide
  Target: AGXT; (+) strand; PAM type: YTN; PAM sequence: TTG
gacgtgggaggtctgagatg

SEQ ID NO: 17646 - DNA, 20 bp, Artificial Sequence
  Description of Artificial Sequence: Synthetic oligonucleotide
  Target: AGXT; (+) strand; PAM type: YTN; PAM sequence: CTG
agatgccagctggaccacac

SEQ ID NO: 17647 - DNA, 20 bp, Artificial Sequence
  Description of Artificial Sequence: Synthetic oligonucleotide
  Target: AGXT; (+) strand; PAM type: YTN; PAM sequence: CTG
gaccacacgggagggtgaag

SEQ ID NO: 17648 - DNA, 20 bp, Artificial Sequence
  Description of Artificial Sequence: Synthetic oligonucleotide
  Target: AGXT; (+) strand; PAM type: YTN; PAM sequence: CTG
ggtgtgagtcaggagcctgg

SEQ ID NO: 17649 - DNA, 20 bp, Artificial Sequence
  Description of Artificial Sequence: Synthetic oligonucleotide
  Target: AGXT; (+) strand; PAM type: YTN; PAM sequence: CTG
gggagaggccggggctggcc

SEQ ID NO: 17650 - DNA, 20 bp, Artificial Sequence
  Description of Artificial Sequence: Synthetic oligonucleotide
  Target: AGXT; (+) strand; PAM type: YTN; PAM sequence: CTG
gcccctccatctggagttgt

SEQ ID NO: 17651 - DNA, 20 bp, Artificial Sequence
  Description of Artificial Sequence: Synthetic oligonucleotide
  Target: AGXT; (+) strand; PAM type: YTN; PAM sequence: CTC
catctggagttgtagagacg

SEQ ID NO: 17652 - DNA, 20 bp, Artificial Sequence
  Description of Artificial Sequence: Synthetic oligonucleotide
  Target: AGXT; (+) strand; PAM type: YTN; PAM sequence: CTG
gagttgtagagacggacaca

SEQ ID NO: 17653 - DNA, 20 bp, Artificial Sequence
  Description of Artificial Sequence: Synthetic oligonucleotide
  Target: AGXT; (+) strand; PAM type: YTN; PAM sequence: TTG
tagagacggacacatttaaa

SEQ ID NO: 17654 - DNA, 20 bp, Artificial Sequence
  Description of Artificial Sequence: Synthetic oligonucleotide
  Target: AGXT; (+) strand; PAM type: YTN; PAM sequence: TTT
aaagtttcaagcctggccag

SEQ ID NO: 17655 - DNA, 20 bp, Artificial Sequence
  Description of Artificial Sequence: Synthetic oligonucleotide
  Target: AGXT; (+) strand; PAM type: YTN; PAM sequence: TTA
aagtttcaagcctggccagt

SEQ ID NO: 17656 - DNA, 20 bp, Artificial Sequence
  Description of Artificial Sequence: Synthetic oligonucleotide
  Target: AGXT; (+) strand; PAM type: YTN; PAM sequence: TTT
caagcctggccagtgtcccc

SEQ ID NO: 17657 - DNA, 20 bp, Artificial Sequence
  Description of Artificial Sequence: Synthetic oligonucleotide
  Target: AGXT; (+) strand; PAM type: YTN; PAM sequence: TTC
aagcctggccagtgtcccct

SEQ ID NO: 17658 - DNA, 20 bp, Artificial Sequence
  Description of Artificial Sequence: Synthetic oligonucleotide
  Target: AGXT; (+) strand; PAM type: YTN; PAM sequence: CTG
gccagtgtcccctggggccc

SEQ ID NO: 17659 - DNA, 20 bp, Artificial Sequence
  Description of Artificial Sequence: Synthetic oligonucleotide
  Target: AGXT; (+) strand; PAM type: YTN; PAM sequence: CTG
gggcccgaaagcagtcacct

SEQ ID NO: 17660 - DNA, 20 bp, Artificial Sequence
  Description of Artificial Sequence: Synthetic oligonucleotide
  Target: AGXT; (+) strand; PAM type: YTN; PAM sequence: CTT
tgggtgatgtgagaaatgaa

SEQ ID NO: 17661 - DNA, 20 bp, Artificial Sequence
  Description of Artificial Sequence: Synthetic oligonucleotide
  Target: AGXT; (+) strand; PAM type: YTN; PAM sequence: TTT
gggtgatgtgagaaatgaag

SEQ ID NO: 17662 - DNA, 20 bp, Artificial Sequence
  Description of Artificial Sequence: Synthetic oligonucleotide
  Target: AGXT; (+) strand; PAM type: YTN; PAM sequence: TTG
ggtgatgtgagaaatgaagg

SEQ ID NO: 17663 - DNA, 20 bp, Artificial Sequence
  Description of Artificial Sequence: Synthetic oligonucleotide
  Target: AGXT; (+) strand; PAM type: YTN; PAM sequence: CTG
accctgtaggaggggctggg

SEQ ID NO: 17664 - DNA, 20 bp, Artificial Sequence
  Description of Artificial Sequence: Synthetic oligonucleotide
  Target: AGXT; (+) strand; PAM type: YTN; PAM sequence: CTG
taggaggggctgggggagag

SEQ ID NO: 17665 - DNA, 20 bp, Artificial Sequence
  Description of Artificial Sequence: Synthetic oligonucleotide
  Target: AGXT; (+) strand; PAM type: YTN; PAM sequence: CTG
ggggagagaaaggggcacac

SEQ ID NO: 17666 - DNA, 20 bp, Artificial Sequence
  Description of Artificial Sequence: Synthetic oligonucleotide
  Target: AGXT; (+) strand; PAM type: YTN; PAM sequence: CTG
gccttggtgcccccatggca

SEQ ID NO: 17667 - DNA, 20 bp, Artificial Sequence
  Description of Artificial Sequence: Synthetic oligonucleotide
  Target: AGXT; (+) strand; PAM type: YTN; PAM sequence: CTT
ggtgcccccatggcagggtc

SEQ ID NO: 17668 - DNA, 20 bp, Artificial Sequence
  Description of Artificial Sequence: Synthetic oligonucleotide
  Target: AGXT; (+) strand; PAM type: YTN; PAM sequence: TTG
gtgcccccatggcagggtca

SEQ ID NO: 17669 - DNA, 20 bp, Artificial Sequence
  Description of Artificial Sequence: Synthetic oligonucleotide
  Target: AGXT; (+) strand; PAM type: YTN; PAM sequence: CTG
ggcccaagggccagcgggac

SEQ ID NO: 17670 - DNA, 20 bp, Artificial Sequence
  Description of Artificial Sequence: Synthetic oligonucleotide
  Target: AGXT; (+) strand; PAM type: YTN; PAM sequence: CTG
gacagctgagggacccacga

SEQ ID NO: 17671 - DNA, 20 bp, Artificial Sequence
  Description of Artificial Sequence: Synthetic oligonucleotide
  Target: AGXT; (+) strand; PAM type: YTN; PAM sequence: CTG
agggacccacgacccacccg

SEQ ID NO: 17672 - DNA, 20 bp, Artificial Sequence
  Description of Artificial Sequence: Synthetic oligonucleotide
  Target: AGXT; (+) strand; PAM type: YTN; PAM sequence: CTC
tggcccctgagcacaaatgc

SEQ ID NO: 17673 - DNA, 20 bp, Artificial Sequence
  Description of Artificial Sequence: Synthetic oligonucleotide
  Target: AGXT; (+) strand; PAM type: YTN; PAM sequence: CTG
gcccctgagcacaaatgcag

SEQ ID NO: 17674 - DNA, 20 bp, Artificial Sequence
  Description of Artificial Sequence: Synthetic oligonucleotide
  Target: AGXT; (+) strand; PAM type: YTN; PAM sequence: CTG
agcacaaatgcagctggggc

SEQ ID NO: 17675 - DNA, 20 bp, Artificial Sequence
  Description of Artificial Sequence: Synthetic oligonucleotide
  Target: AGXT; (+) strand; PAM type: YTN; PAM sequence: CTG
gggcgggccctcctgggggc

SEQ ID NO: 17676 - DNA, 20 bp, Artificial Sequence
  Description of Artificial Sequence: Synthetic oligonucleotide
  Target: AGXT; (+) strand; PAM type: YTN; PAM sequence: CTC
ctgggggccccaccccgtct

SEQ ID NO: 17677 - DNA, 20 bp, Artificial Sequence
  Description of Artificial Sequence: Synthetic oligonucleotide
  Target: AGXT; (+) strand; PAM type: YTN; PAM sequence: CTG
ggggccccaccccgtctcac

SEQ ID NO: 17678 - DNA, 20 bp, Artificial Sequence
  Description of Artificial Sequence: Synthetic oligonucleotide
  Target: AGXT; (+) strand; PAM type: YTN; PAM sequence: CTC
actcccgtgaaacaggacag

SEQ ID NO: 17679 - DNA, 20 bp, Artificial Sequence
  Description of Artificial Sequence: Synthetic oligonucleotide
  Target: AGXT; (+) strand; PAM type: YTN; PAM sequence: CTC
ccgtgaaacaggacagccag

SEQ ID NO: 17680 - DNA, 20 bp, Artificial Sequence
  Description of Artificial Sequence: Synthetic oligonucleotide
  Target: AGXT; (+) strand; PAM type: YTN; PAM sequence: CTG
ccctggccttcagcccaaac

SEQ ID NO: 17681 - DNA, 20 bp, Artificial Sequence
  Description of Artificial Sequence: Synthetic oligonucleotide
  Target: AGXT; (+) strand; PAM type: YTN; PAM sequence: CTG
gccttcagcccaaactgaga

SEQ ID NO: 17682 - DNA, 20 bp, Artificial Sequence
  Description of Artificial Sequence: Synthetic oligonucleotide
  Target: AGXT; (+) strand; PAM type: YTN; PAM sequence: CTT
cagcccaaactgagaggctg

SEQ ID NO: 17683 - DNA, 20 bp, Artificial Sequence
  Description of Artificial Sequence: Synthetic oligonucleotide
  Target: AGXT; (+) strand; PAM type: YTN; PAM sequence: TTC
agcccaaactgagaggctgg

SEQ ID NO: 17684 - DNA, 20 bp, Artificial Sequence
  Description of Artificial Sequence: Synthetic oligonucleotide
  Target: AGXT; (+) strand; PAM type: YTN; PAM sequence: CTG
agaggctggtgctcagcctg

SEQ ID NO: 17685 - DNA, 20 bp, Artificial Sequence
  Description of Artificial Sequence: Synthetic oligonucleotide
  Target: AGXT; (+) strand; PAM type: YTN; PAM sequence: CTG
gtgctcagcctgcttctttc

SEQ ID NO: 17686 - DNA, 20 bp, Artificial Sequence
  Description of Artificial Sequence: Synthetic oligonucleotide
  Target: AGXT; (+) strand; PAM type: YTN; PAM sequence: CTC
agcctgcttctttctcccca

SEQ ID NO: 17687 - DNA, 20 bp, Artificial Sequence
  Description of Artificial Sequence: Synthetic oligonucleotide
  Target: AGXT; (+) strand; PAM type: YTN; PAM sequence: CTG
cttctttctccccagaaaga

SEQ ID NO: 17688 - DNA, 20 bp, Artificial Sequence
  Description of Artificial Sequence: Synthetic oligonucleotide
  Target: AGXT; (+) strand; PAM type: YTN; PAM sequence: CTT
ctttctccccagaaagaaga

SEQ ID NO: 17689 - DNA, 20 bp, Artificial Sequence
  Description of Artificial Sequence: Synthetic oligonucleotide
  Target: AGXT; (+) strand; PAM type: YTN; PAM sequence: TTC
tttctccccagaaagaagat

SEQ ID NO: 17690 - DNA, 20 bp, Artificial Sequence
  Description of Artificial Sequence: Synthetic oligonucleotide
  Target: AGXT; (+) strand; PAM type: YTN; PAM sequence: CTT
tctccccagaaagaagatgt

SEQ ID NO: 17691 - DNA, 20 bp, Artificial Sequence
  Description of Artificial Sequence: Synthetic oligonucleotide
  Target: AGXT; (+) strand; PAM type: YTN; PAM sequence: TTT
ctccccagaaagaagatgta

SEQ ID NO: 17692 - DNA, 20 bp, Artificial Sequence
  Description of Artificial Sequence: Synthetic oligonucleotide
  Target: AGXT; (+) strand; PAM type: YTN; PAM sequence: TTC
tccccagaaagaagatgtac

SEQ ID NO: 17693 - DNA, 20 bp, Artificial Sequence
  Description of Artificial Sequence: Synthetic oligonucleotide
  Target: AGXT; (+) strand; PAM type: YTN; PAM sequence: CTC
cccagaaagaagatgtactc

SEQ ID NO: 17694 - DNA, 20 bp, Artificial Sequence
  Description of Artificial Sequence: Synthetic oligonucleotide
  Target: AGXT; (+) strand; PAM type: YTN; PAM sequence: CTC
ccgcaagacgaagcccttct

SEQ ID NO: 17695 - DNA, 20 bp, Artificial Sequence
  Description of Artificial Sequence: Synthetic oligonucleotide
  Target: AGXT; (+) strand; PAM type: YTN; PAM sequence: CTT
ctccttctacctggacatca

SEQ ID NO: 17696 - DNA, 20 bp, Artificial Sequence
  Description of Artificial Sequence: Synthetic oligonucleotide
  Target: AGXT; (+) strand; PAM type: YTN; PAM sequence: TTC
tccttctacctggacatcaa

SEQ ID NO: 17697 - DNA, 20 bp, Artificial Sequence
  Description of Artificial Sequence: Synthetic oligonucleotide
  Target: AGXT; (+) strand; PAM type: YTN; PAM sequence: CTC
cttctacctggacatcaagt

SEQ ID NO: 17698 - DNA, 20 bp, Artificial Sequence
  Description of Artificial Sequence: Synthetic oligonucleotide
  Target: AGXT; (+) strand; PAM type: YTN; PAM sequence: CTT
ctacctggacatcaagtggc

SEQ ID NO: 17699 - DNA, 20 bp, Artificial Sequence
  Description of Artificial Sequence: Synthetic oligonucleotide
  Target: AGXT; (+) strand; PAM type: YTN; PAM sequence: TTC
tacctggacatcaagtggct

SEQ ID NO: 17700 - DNA, 20 bp, Artificial Sequence
  Description of Artificial Sequence: Synthetic oligonucleotide
  Target: AGXT; (+) strand; PAM type: YTN; PAM sequence: CTA
cctggacatcaagtggctgg

SEQ ID NO: 17701 - DNA, 20 bp, Artificial Sequence
  Description of Artificial Sequence: Synthetic oligonucleotide
  Target: AGXT; (+) strand; PAM type: YTN; PAM sequence: CTG
gacatcaagtggctggccaa

SEQ ID NO: 17702 - DNA, 20 bp, Artificial Sequence
  Description of Artificial Sequence: Synthetic oligonucleotide
  Target: AGXT; (+) strand; PAM type: YTN; PAM sequence: CTG
gccaacttctggggctgtga

SEQ ID NO: 17703 - DNA, 20 bp, Artificial Sequence
  Description of Artificial Sequence: Synthetic oligonucleotide
  Target: AGXT; (+) strand; PAM type: YTN; PAM sequence: CTT
ctggggctgtgacgaccagc

SEQ ID NO: 17704 - DNA, 20 bp, Artificial Sequence
  Description of Artificial Sequence: Synthetic oligonucleotide
  Target: AGXT; (+) strand; PAM type: YTN; PAM sequence: TTC
tggggctgtgacgaccagcc

SEQ ID NO: 17705 - DNA, 20 bp, Artificial Sequence
  Description of Artificial Sequence: Synthetic oligonucleotide
  Target: AGXT; (+) strand; PAM type: YTN; PAM sequence: CTG
gggctgtgacgaccagccca

SEQ ID NO: 17706 - DNA, 20 bp, Artificial Sequence
  Description of Artificial Sequence: Synthetic oligonucleotide
  Target: AGXT; (+) strand; PAM type: YTN; PAM sequence: CTG
tgacgaccagcccaggatgt

SEQ ID NO: 17707 - DNA, 20 bp, Artificial Sequence
  Description of Artificial Sequence: Synthetic oligonucleotide
  Target: AGXT; (+) strand; PAM type: YTN; PAM sequence: CTG
gcagggatgggaaggtggag

SEQ ID NO: 17708 - DNA, 20 bp, Artificial Sequence
  Description of Artificial Sequence: Synthetic oligonucleotide
  Target: AGXT; (+) strand; PAM type: YTN; PAM sequence: CTG
ggcatggctgagaggtgggg

SEQ ID NO: 17709 - DNA, 20 bp, Artificial Sequence
  Description of Artificial Sequence: Synthetic oligonucleotide
  Target: AGXT; (+) strand; PAM type: YTN; PAM sequence: CTG
agaggtggggcgctggcctc

SEQ ID NO: 17710 - DNA, 20 bp, Artificial Sequence
  Description of Artificial Sequence: Synthetic oligonucleotide
  Target: AGXT; (+) strand; PAM type: YTN; PAM sequence: CTG
gcctctcactgcactcaggg

SEQ ID NO: 17711 - DNA, 20 bp, Artificial Sequence
  Description of Artificial Sequence: Synthetic oligonucleotide
  Target: AGXT; (+) strand; PAM type: YTN; PAM sequence: CTC
tcactgcactcagggattct

SEQ ID NO: 17712 - DNA, 20 bp, Artificial Sequence
  Description of Artificial Sequence: Synthetic oligonucleotide
  Target: AGXT; (+) strand; PAM type: YTN; PAM sequence: CTC
actgcactcagggattctcc

SEQ ID NO: 17713 - DNA, 20 bp, Artificial Sequence
  Description of Artificial Sequence: Synthetic oligonucleotide
  Target: AGXT; (+) strand; PAM type: YTN; PAM sequence: CTG
cactcagggattctccaagc

SEQ ID NO: 17714 - DNA, 20 bp, Artificial Sequence
  Description of Artificial Sequence: Synthetic oligonucleotide
  Target: AGXT; (+) strand; PAM type: YTN; PAM sequence: CTC
agggattctccaagcccccc

SEQ ID NO: 17715 - DNA, 20 bp, Artificial Sequence
  Description of Artificial Sequence: Synthetic oligonucleotide
  Target: AGXT; (+) strand; PAM type: YTN; PAM sequence: TTC
tccaagccccccaccttcat

SEQ ID NO: 17716 - DNA, 20 bp, Artificial Sequence
  Description of Artificial Sequence: Synthetic oligonucleotide
  Target: AGXT; (+) strand; PAM type: YTN; PAM sequence: CTC
caagccccccaccttcatgc

SEQ ID NO: 17717 - DNA, 20 bp, Artificial Sequence
  Description of Artificial Sequence: Synthetic oligonucleotide
  Target: AGXT; (+) strand; PAM type: YTN; PAM sequence: CTT
catgcctcaagaaccccaac

SEQ ID NO: 17718 - DNA, 20 bp, Artificial Sequence
  Description of Artificial Sequence: Synthetic oligonucleotide
  Target: AGXT; (+) strand; PAM type: YTN; PAM sequence: TTC
atgcctcaagaaccccaact

SEQ ID NO: 17719 - DNA, 20 bp, Artificial Sequence
  Description of Artificial Sequence: Synthetic oligonucleotide
  Target: AGXT; (+) strand; PAM type: YTN; PAM sequence: CTC
aagaaccccaactagagccc

SEQ ID NO: 17720 - DNA, 20 bp, Artificial Sequence
  Description of Artificial Sequence: Synthetic oligonucleotide
  Target: AGXT; (+) strand; PAM type: YTN; PAM sequence: CTA
gagccccagaatccgcctgc

SEQ ID NO: 17721 - DNA, 20 bp, Artificial Sequence
  Description of Artificial Sequence: Synthetic oligonucleotide
  Target: AGXT; (+) strand; PAM type: YTN; PAM sequence: CTG
catcaggcagtcaaatgccc

SEQ ID NO: 17722 - DNA, 20 bp, Artificial Sequence
  Description of Artificial Sequence: Synthetic oligonucleotide
  Target: AGXT; (+) strand; PAM type: YTN; PAM sequence: CTG
ggttcccccattcctcgact

SEQ ID NO: 17723 - DNA, 20 bp, Artificial Sequence
  Description of Artificial Sequence: Synthetic oligonucleotide
  Target: AGXT; (+) strand; PAM type: YTN; PAM sequence: TTC
ccccattcctcgactggccc

SEQ ID NO: 17724 - DNA, 20 bp, Artificial Sequence
  Description of Artificial Sequence: Synthetic oligonucleotide
  Target: AGXT; (+) strand; PAM type: YTN; PAM sequence: TTC
ctcgactggcccgaggctct

SEQ ID NO: 17725 - DNA, 20 bp, Artificial Sequence
  Description of Artificial Sequence: Synthetic oligonucleotide
  Target: AGXT; (+) strand; PAM type: YTN; PAM sequence: CTC
gactggcccgaggctctggg

SEQ ID NO: 17726 - DNA, 20 bp, Artificial Sequence
  Description of Artificial Sequence: Synthetic oligonucleotide
  Target: AGXT; (+) strand; PAM type: YTN; PAM sequence: CTG
gcccgaggctctgggcaggg

SEQ ID NO: 17727 - DNA, 20 bp, Artificial Sequence
  Description of Artificial Sequence: Synthetic oligonucleotide
  Target: AGXT; (+) strand; PAM type: YTN; PAM sequence: CTC
tgggcagggtcatggccccc

SEQ ID NO: 17728 - DNA, 20 bp, Artificial Sequence
  Description of Artificial Sequence: Synthetic oligonucleotide
  Target: AGXT; (+) strand; PAM type: YTN; PAM sequence: CTG
ggcagggtcatggcccccac

SEQ ID NO: 17729 - DNA, 20 bp, Artificial Sequence
  Description of Artificial Sequence: Synthetic oligonucleotide
  Target: AGXT; (+) strand; PAM type: YTN; PAM sequence: CTG
ccgcttccacaaacactgtc

SEQ ID NO: 17730 - DNA, 20 bp, Artificial Sequence
  Description of Artificial Sequence: Synthetic oligonucleotide
  Target: AGXT; (+) strand; PAM type: YTN; PAM sequence: CTT
ccacaaacactgtcccccca

SEQ ID NO: 17731 - DNA, 20 bp, Artificial Sequence
  Description of Artificial Sequence: Synthetic oligonucleotide
  Target: AGXT; (+) strand; PAM type: YTN; PAM sequence: TTC
cacaaacactgtccccccag

SEQ ID NO: 17732 - DNA, 20 bp, Artificial Sequence
  Description of Artificial Sequence: Synthetic oligonucleotide
  Target: AGXT; (+) strand; PAM type: YTN; PAM sequence: CTG
tccccccagaggtcccagca

SEQ ID NO: 17733 - DNA, 20 bp, Artificial Sequence
  Description of Artificial Sequence: Synthetic oligonucleotide
  Target: AGXT; (+) strand; PAM type: YTN; PAM sequence: CTC
gggcactttggacctggccc

SEQ ID NO: 17734 - DNA, 20 bp, Artificial Sequence
  Description of Artificial Sequence: Synthetic oligonucleotide
  Target: AGXT; (+) strand; PAM type: YTN; PAM sequence: CTT
tggacctggccctgccacat

SEQ ID NO: 17735 - DNA, 20 bp, Artificial Sequence
  Description of Artificial Sequence: Synthetic oligonucleotide
  Target: AGXT; (+) strand; PAM type: YTN; PAM sequence: TTT
ggacctggccctgccacatc

SEQ ID NO: 17736 - DNA, 20 bp, Artificial Sequence
  Description of Artificial Sequence: Synthetic oligonucleotide
  Target: AGXT; (+) strand; PAM type: YTN; PAM sequence: TTG
gacctggccctgccacatct

SEQ ID NO: 17737 - DNA, 20 bp, Artificial Sequence
  Description of Artificial Sequence: Synthetic oligonucleotide
  Target: AGXT; (+) strand; PAM type: YTN; PAM sequence: CTG
gccctgccacatctccccac

SEQ ID NO: 17738 - DNA, 20 bp, Artificial Sequence
  Description of Artificial Sequence: Synthetic oligonucleotide
  Target: AGXT; (+) strand; PAM type: YTN; PAM sequence: CTG
ccacatctccccactcctgg

SEQ ID NO: 17739 - DNA, 20 bp, Artificial Sequence
  Description of Artificial Sequence: Synthetic oligonucleotide
  Target: AGXT; (+) strand; PAM type: YTN; PAM sequence: CTC
cccactcctgggcctcagct

SEQ ID NO: 17740 - DNA, 20 bp, Artificial Sequence
  Description of Artificial Sequence: Synthetic oligonucleotide
  Target: AGXT; (+) strand; PAM type: YTN; PAM sequence: CTC
ctgggcctcagcttacccct

SEQ ID NO: 17741 - DNA, 20 bp, Artificial Sequence
  Description of Artificial Sequence: Synthetic oligonucleotide
  Target: AGXT; (+) strand; PAM type: YTN; PAM sequence: CTG
ggcctcagcttaccccttct

SEQ ID NO: 17742 - DNA, 20 bp, Artificial Sequence
  Description of Artificial Sequence: Synthetic oligonucleotide
  Target: AGXT; (+) strand; PAM type: YTN; PAM sequence: CTC
agcttaccccttctgaaaag

SEQ ID NO: 17743 - DNA, 20 bp, Artificial Sequence
  Description of Artificial Sequence: Synthetic oligonucleotide
  Target: AGXT; (+) strand; PAM type: YTN; PAM sequence: CTT
accccttctgaaaagacgac

SEQ ID NO: 17744 - DNA, 20 bp, Artificial Sequence
  Description of Artificial Sequence: Synthetic oligonucleotide
  Target: AGXT; (+) strand; PAM type: YTN; PAM sequence: TTA
ccccttctgaaaagacgacc

SEQ ID NO: 17745 - DNA, 20 bp, Artificial Sequence
  Description of Artificial Sequence: Synthetic oligonucleotide
  Target: AGXT; (+) strand; PAM type: YTN; PAM sequence: CTT
ctgaaaagacgaccttggcc

SEQ ID NO: 17746 - DNA, 20 bp, Artificial Sequence
  Description of Artificial Sequence: Synthetic oligonucleotide
  Target: AGXT; (+) strand; PAM type: YTN; PAM sequence: TTC
tgaaaagacgaccttggcca

SEQ ID NO: 17747 - DNA, 20 bp, Artificial Sequence
  Description of Artificial Sequence: Synthetic oligonucleotide
  Target: AGXT; (+) strand; PAM type: YTN; PAM sequence: CTG
aaaagacgaccttggccata

SEQ ID NO: 17748 - DNA, 20 bp, Artificial Sequence
  Description of Artificial Sequence: Synthetic oligonucleotide
  Target: AGXT; (+) strand; PAM type: YTN; PAM sequence: CTT
ggccataaacccaaggcccc

SEQ ID NO: 17749 - DNA, 20 bp, Artificial Sequence
  Description of Artificial Sequence: Synthetic oligonucleotide
  Target: AGXT; (+) strand; PAM type: YTN; PAM sequence: TTG
gccataaacccaaggcccct

SEQ ID NO: 17750 - DNA, 20 bp, Artificial Sequence
  Description of Artificial Sequence: Synthetic oligonucleotide
  Target: AGXT; (+) strand; PAM type: YTN; PAM sequence: CTT
atgttacacacaggaacaag

SEQ ID NO: 17751 - DNA, 20 bp, Artificial Sequence
  Description of Artificial Sequence: Synthetic oligonucleotide
  Target: AGXT; (+) strand; PAM type: YTN; PAM sequence: TTA
tgttacacacaggaacaagg

SEQ ID NO: 17752 - DNA, 20 bp, Artificial Sequence
  Description of Artificial Sequence: Synthetic oligonucleotide
  Target: AGXT; (+) strand; PAM type: YTN; PAM sequence: TTA
cacacaggaacaaggcgcca

SEQ ID NO: 17753 - DNA, 20 bp, Artificial Sequence
  Description of Artificial Sequence: Synthetic oligonucleotide
  Target: AGXT; (+) strand; PAM type: YTN; PAM sequence: CTA
gcccagtgggcacagagggc

SEQ ID NO: 17754 - DNA, 20 bp, Artificial Sequence
  Description of Artificial Sequence: Synthetic oligonucleotide
  Target: AGXT; (+) strand; PAM type: YTN; PAM sequence: CTT
cgcaggcacgctgggactga

SEQ ID NO: 17755 - DNA, 20 bp, Artificial Sequence
  Description of Artificial Sequence: Synthetic oligonucleotide
  Target: AGXT; (+) strand; PAM type: YTN; PAM sequence: TTC
gcaggcacgctgggactgag

SEQ ID NO: 17756 - DNA, 20 bp, Artificial Sequence
  Description of Artificial Sequence: Synthetic oligonucleotide
  Target: AGXT; (+) strand; PAM type: YTN; PAM sequence: CTG
ggactgaggggctccgcagg

SEQ ID NO: 17757 - DNA, 20 bp, Artificial Sequence
  Description of Artificial Sequence: Synthetic oligonucleotide
  Target: AGXT; (+) strand; PAM type: YTN; PAM sequence: CTG
aggggctccgcagggaggtg

SEQ ID NO: 17758 - DNA, 20 bp, Artificial Sequence
  Description of Artificial Sequence: Synthetic oligonucleotide
  Target: AGXT; (+) strand; PAM type: YTN; PAM sequence: CTC
cgcagggaggtggtggcacg

SEQ ID NO: 17759 - DNA, 20 bp, Artificial Sequence
  Description of Artificial Sequence: Synthetic oligonucleotide
  Target: AGXT; (+) strand; PAM type: YTN; PAM sequence: CTC
tgctcctgcagccacccact

SEQ ID NO: 17760 - DNA, 20 bp, Artificial Sequence
  Description of Artificial Sequence: Synthetic oligonucleotide
  Target: AGXT; (+) strand; PAM type: YTN; PAM sequence: CTG
ctcctgcagccacccactgc

SEQ ID NO: 17761 - DNA, 20 bp, Artificial Sequence
  Description of Artificial Sequence: Synthetic oligonucleotide
  Target: AGXT; (+) strand; PAM type: YTN; PAM sequence: CTC
ctgcagccacccactgcctc

SEQ ID NO: 17762 - DNA, 20 bp, Artificial Sequence
  Description of Artificial Sequence: Synthetic oligonucleotide
  Target: AGXT; (+) strand; PAM type: YTN; PAM sequence: CTG
cagccacccactgcctcctg

SEQ ID NO: 17763 - DNA, 20 bp, Artificial Sequence
  Description of Artificial Sequence: Synthetic oligonucleotide
  Target: AGXT; (+) strand; PAM type: YTN; PAM sequence: CTG
cctcctggctgggccctaca

SEQ ID NO: 17764 - DNA, 20 bp, Artificial Sequence
  Description of Artificial Sequence: Synthetic oligonucleotide
  Target: AGXT; (+) strand; PAM type: YTN; PAM sequence: CTC
ctggctgggccctacacaag

SEQ ID NO: 17765 - DNA, 20 bp, Artificial Sequence
  Description of Artificial Sequence: Synthetic oligonucleotide
  Target: AGXT; (+) strand; PAM type: YTN; PAM sequence: CTG
gctgggccctacacaagcca

SEQ ID NO: 17766 - DNA, 20 bp, Artificial Sequence
  Description of Artificial Sequence: Synthetic oligonucleotide
  Target: AGXT; (+) strand; PAM type: YTN; PAM sequence: CTG
ggccctacacaagccatgct

SEQ ID NO: 17767 - DNA, 20 bp, Artificial Sequence
  Description of Artificial Sequence: Synthetic oligonucleotide
  Target: AGXT; (+) strand; PAM type: YTN; PAM sequence: CTA
cacaagccatgctctccctg

SEQ ID NO: 17768 - DNA, 20 bp, Artificial Sequence
  Description of Artificial Sequence: Synthetic oligonucleotide
  Target: AGXT; (+) strand; PAM type: YTN; PAM sequence: CTC
tccctggcagacgaagctgc

SEQ ID NO: 17769 - DNA, 20 bp, Artificial Sequence
  Description of Artificial Sequence: Synthetic oligonucleotide
  Target: AGXT; (+) strand; PAM type: YTN; PAM sequence: CTC
cctggcagacgaagctgcct

SEQ ID NO: 17770 - DNA, 20 bp, Artificial Sequence
  Description of Artificial Sequence: Synthetic oligonucleotide
  Target: AGXT; (+) strand; PAM type: YTN; PAM sequence: CTG
gcagacgaagctgccttccc

SEQ ID NO: 17771 - DNA, 20 bp, Artificial Sequence
  Description of Artificial Sequence: Synthetic oligonucleotide
  Target: AGXT; (+) strand; PAM type: YTN; PAM sequence: CTG
ccttcccggtccaaagttct

SEQ ID NO: 17772 - DNA, 20 bp, Artificial Sequence
  Description of Artificial Sequence: Synthetic oligonucleotide
  Target: AGXT; (+) strand; PAM type: YTN; PAM sequence: CTT
cccggtccaaagttctgaac

SEQ ID NO: 17773 - DNA, 20 bp, Artificial Sequence
  Description of Artificial Sequence: Synthetic oligonucleotide
  Target: AGXT; (+) strand; PAM type: YTN; PAM sequence: TTC
ccggtccaaagttctgaacc

SEQ ID NO: 17774 - DNA, 20 bp, Artificial Sequence
  Description of Artificial Sequence: Synthetic oligonucleotide
  Target: AGXT; (+) strand; PAM type: YTN; PAM sequence: TTC
tgaacccggacaggactcct

SEQ ID NO: 17775 - DNA, 20 bp, Artificial Sequence
  Description of Artificial Sequence: Synthetic oligonucleotide
  Target: AGXT; (+) strand; PAM type: YTN; PAM sequence: CTG
aacccggacaggactcctct

SEQ ID NO: 17776 - DNA, 20 bp, Artificial Sequence
  Description of Artificial Sequence: Synthetic oligonucleotide
  Target: AGXT; (+) strand; PAM type: YTN; PAM sequence: CTC
ctctgcggaggataccggcc

SEQ ID NO: 17777 - DNA, 20 bp, Artificial Sequence
  Description of Artificial Sequence: Synthetic oligonucleotide
  Target: AGXT; (+) strand; PAM type: YTN; PAM sequence: CTC
tgcggaggataccggcctgt

SEQ ID NO: 17778 - DNA, 20 bp, Artificial Sequence
  Description of Artificial Sequence: Synthetic oligonucleotide
  Target: AGXT; (+) strand; PAM type: YTN; PAM sequence: CTG
cggaggataccggcctgtgg

SEQ ID NO: 17779 - DNA, 20 bp, Artificial Sequence
  Description of Artificial Sequence: Synthetic oligonucleotide
  Target: AGXT; (+) strand; PAM type: YTN; PAM sequence: CTG
tggtcagagagcctgtgctg

SEQ ID NO: 17780 - DNA, 20 bp, Artificial Sequence
  Description of Artificial Sequence: Synthetic oligonucleotide
  Target: AGXT; (+) strand; PAM type: YTN; PAM sequence: CTG
tgctgttggggctggggcag

SEQ ID NO: 17781 - DNA, 20 bp, Artificial Sequence
  Description of Artificial Sequence: Synthetic oligonucleotide
  Target: AGXT; (+) strand; PAM type: YTN; PAM sequence: CTG
ttggggctggggcagacaga

SEQ ID NO: 17782 - DNA, 20 bp, Artificial Sequence
  Description of Artificial Sequence: Synthetic oligonucleotide
  Target: AGXT; (+) strand; PAM type: YTN; PAM sequence: TTG
gggctggggcagacagagct

SEQ ID NO: 17783 - DNA, 20 bp, Artificial Sequence
  Description of Artificial Sequence: Synthetic oligonucleotide
  Target: AGXT; (+) strand; PAM type: YTN; PAM sequence: CTG
gggcagacagagctaatgcc

SEQ ID NO: 17784 - DNA, 20 bp, Artificial Sequence
  Description of Artificial Sequence: Synthetic oligonucleotide
  Target: AGXT; (+) strand; PAM type: YTN; PAM sequence: CTA
atgccccatctgcccccaac

SEQ ID NO: 17785 - DNA, 20 bp, Artificial Sequence
  Description of Artificial Sequence: Synthetic oligonucleotide
  Target: AGXT; (+) strand; PAM type: YTN; PAM sequence: CTG
cccccaaccctgcccatggt

SEQ ID NO: 17786 - DNA, 20 bp, Artificial Sequence
  Description of Artificial Sequence: Synthetic oligonucleotide
  Target: AGXT; (+) strand; PAM type: YTN; PAM sequence: CTG
cccatggtgctggaccaagc

SEQ ID NO: 17787 - DNA, 20 bp, Artificial Sequence
  Description of Artificial Sequence: Synthetic oligonucleotide
  Target: AGXT; (+) strand; PAM type: YTN; PAM sequence: CTG
gaccaagccccctcgtgtct

SEQ ID NO: 17788 - DNA, 20 bp, Artificial Sequence
  Description of Artificial Sequence: Synthetic oligonucleotide
  Target: AGXT; (+) strand; PAM type: YTN; PAM sequence: CTC
gtgtcttccaggtaccatca

SEQ ID NO: 17789 - DNA, 20 bp, Artificial Sequence
  Description of Artificial Sequence: Synthetic oligonucleotide
  Target: AGXT; (+) strand; PAM type: YTN; PAM sequence: CTT
ccaggtaccatcacacaatc

SEQ ID NO: 17790 - DNA, 20 bp, Artificial Sequence
  Description of Artificial Sequence: Synthetic oligonucleotide
  Target: AGXT; (+) strand; PAM type: YTN; PAM sequence: TTC
caggtaccatcacacaatcc

SEQ ID NO: 17791 - DNA, 20 bp, Artificial Sequence
  Description of Artificial Sequence: Synthetic oligonucleotide
  Target: AGXT; (+) strand; PAM type: YTN; PAM sequence: CTG
tacagcctgagagagagcct

SEQ ID NO: 17792 - DNA, 20 bp, Artificial Sequence
  Description of Artificial Sequence: Synthetic oligonucleotide
  Target: AGXT; (+) strand; PAM type: YTN; PAM sequence: CTG
agagagagcctggccctcat

SEQ ID NO: 17793 - DNA, 20 bp, Artificial Sequence
  Description of Artificial Sequence: Synthetic oligonucleotide
  Target: AGXT; (+) strand; PAM type: YTN; PAM sequence: CTG
gccctcattgcggaacaggt

SEQ ID NO: 17794 - DNA, 20 bp, Artificial Sequence
  Description of Artificial Sequence: Synthetic oligonucleotide
  Target: AGXT; (+) strand; PAM type: YTN; PAM sequence: CTC
attgcggaacaggtgcatgg

SEQ ID NO: 17795 - DNA, 20 bp, Artificial Sequence
  Description of Artificial Sequence: Synthetic oligonucleotide
  Target: AGXT; (+) strand; PAM type: YTN; PAM sequence: TTG
cggaacaggtgcatgggctg

SEQ ID NO: 17796 - DNA, 20 bp, Artificial Sequence
  Description of Artificial Sequence: Synthetic oligonucleotide
  Target: AGXT; (+) strand; PAM type: YTN; PAM sequence: CTG
cactccacaggaggagacag

SEQ ID NO: 17797 - DNA, 20 bp, Artificial Sequence
  Description of Artificial Sequence: Synthetic oligonucleotide
  Target: AGXT; (+) strand; PAM type: YTN; PAM sequence: CTC
cacaggaggagacagggcca

SEQ ID NO: 17798 - DNA, 20 bp, Artificial Sequence
  Description of Artificial Sequence: Synthetic oligonucleotide
  Target: AGXT; (+) strand; PAM type: YTN; PAM sequence: CTG
gctggattgtcgagggcgcg

SEQ ID NO: 17799 - DNA, 20 bp, Artificial Sequence
  Description of Artificial Sequence: Synthetic oligonucleotide
  Target: AGXT; (+) strand; PAM type: YTN; PAM sequence: CTG
gattgtcgagggcgcggcct

SEQ ID NO: 17800 - DNA, 20 bp, Artificial Sequence
  Description of Artificial Sequence: Synthetic oligonucleotide
  Target: AGXT; (+) strand; PAM type: YTN; PAM sequence: TTG
tcgagggcgcggcctgcaga

SEQ ID NO: 17801 - DNA, 20 bp, Artificial Sequence
  Description of Artificial Sequence: Synthetic oligonucleotide
  Target: AGXT; (+) strand; PAM type: YTN; PAM sequence: CTG
cagagaaggaaccatccctg

SEQ ID NO: 17802 - DNA, 20 bp, Artificial Sequence
  Description of Artificial Sequence: Synthetic oligonucleotide
  Target: AGXT; (+) strand; PAM type: YTN; PAM sequence: CTG
gtgcacagagaaaagggagc

SEQ ID NO: 17803 - DNA, 20 bp, Artificial Sequence
  Description of Artificial Sequence: Synthetic oligonucleotide
  Target: AGXT; (+) strand; PAM type: YTN; PAM sequence: CTG
ccagagagaggccctcagtg

SEQ ID NO: 17804 - DNA, 20 bp, Artificial Sequence
  Description of Artificial Sequence: Synthetic oligonucleotide
  Target: AGXT; (+) strand; PAM type: YTN; PAM sequence: CTC
agtgggggtgggggagagag

SEQ ID NO: 17805 - DNA, 20 bp, Artificial Sequence
  Description of Artificial Sequence: Synthetic oligonucleotide
  Target: AGXT; (+) strand; PAM type: YTN; PAM sequence: CTG
gctgcgggcagggccagggg

SEQ ID NO: 17806 - DNA, 20 bp, Artificial Sequence
  Description of Artificial Sequence: Synthetic oligonucleotide
  Target: AGXT; (+) strand; PAM type: YTN; PAM sequence: CTG
cgggcagggccagggggata

SEQ ID NO: 17807 - DNA, 20 bp, Artificial Sequence
  Description of Artificial Sequence: Synthetic oligonucleotide
  Target: AGXT; (+) strand; PAM type: YTN; PAM sequence: CTC
ccaacccttccattgctgtg

SEQ ID NO: 17808 - DNA, 20 bp, Artificial Sequence
  Description of Artificial Sequence: Synthetic oligonucleotide
  Target: AGXT; (+) strand; PAM type: YTN; PAM sequence: CTT
ccattgctgtgtgaagcagt

SEQ ID NO: 17809 - DNA, 20 bp, Artificial Sequence
  Description of Artificial Sequence: Synthetic oligonucleotide
  Target: AGXT; (+) strand; PAM type: YTN; PAM sequence: TTC
cattgctgtgtgaagcagta

SEQ ID NO: 17810 - DNA, 20 bp, Artificial Sequence
  Description of Artificial Sequence: Synthetic oligonucleotide
  Target: AGXT; (+) strand; PAM type: YTN; PAM sequence: TTG
ctgtgtgaagcagtaagtga

SEQ ID NO: 17811 - DNA, 20 bp, Artificial Sequence
  Description of Artificial Sequence: Synthetic oligonucleotide
  Target: AGXT; (+) strand; PAM type: YTN; PAM sequence: CTG
tgtgaagcagtaagtgaggc

SEQ ID NO: 17812 - DNA, 20 bp, Artificial Sequence
  Description of Artificial Sequence: Synthetic oligonucleotide
  Target: AGXT; (+) strand; PAM type: YTN; PAM sequence: CTG
ggagaaggggaggccgaagg

SEQ ID NO: 17813 - DNA, 20 bp, Artificial Sequence
  Description of Artificial Sequence: Synthetic oligonucleotide
  Target: AGXT; (+) strand; PAM type: YTN; PAM sequence: TTG
gcagttcctgcaggcttgtc

SEQ ID NO: 17814 - DNA, 20 bp, Artificial Sequence
  Description of Artificial Sequence: Synthetic oligonucleotide
  Target: AGXT; (+) strand; PAM type: YTN; PAM sequence: TTC
ctgcaggcttgtccagctcc

SEQ ID NO: 17815 - DNA, 20 bp, Artificial Sequence
  Description of Artificial Sequence: Synthetic oligonucleotide
  Target: AGXT; (+) strand; PAM type: YTN; PAM sequence: CTG
caggcttgtccagctcctat

SEQ ID NO: 17816 - DNA, 20 bp, Artificial Sequence
  Description of Artificial Sequence: Synthetic oligonucleotide
  Target: AGXT; (+) strand; PAM type: YTN; PAM sequence: CTT
gtccagctcctatggcaggg

SEQ ID NO: 17817 - DNA, 20 bp, Artificial Sequence
  Description of Artificial Sequence: Synthetic oligonucleotide
  Target: AGXT; (+) strand; PAM type: YTN; PAM sequence: TTG
tccagctcctatggcagggc

SEQ ID NO: 17818 - DNA, 20 bp, Artificial Sequence
  Description of Artificial Sequence: Synthetic oligonucleotide
  Target: AGXT; (+) strand; PAM type: YTN; PAM sequence: CTC
ctatggcagggcaagagctg

SEQ ID NO: 17819 - DNA, 20 bp, Artificial Sequence
  Description of Artificial Sequence: Synthetic oligonucleotide
  Target: AGXT; (+) strand; PAM type: YTN; PAM sequence: CTA
tggcagggcaagagctgagc

SEQ ID NO: 17820 - DNA, 20 bp, Artificial Sequence
  Description of Artificial Sequence: Synthetic oligonucleotide
  Target: AGXT; (+) strand; PAM type: YTN; PAM sequence: CTG
agcatgagcacttgggtgtg

SEQ ID NO: 17821 - DNA, 20 bp, Artificial Sequence
  Description of Artificial Sequence: Synthetic oligonucleotide
  Target: AGXT; (+) strand; PAM type: YTN; PAM sequence: CTT
gggtgtgaccaggggttgat

SEQ ID NO: 17822 - DNA, 20 bp, Artificial Sequence
  Description of Artificial Sequence: Synthetic oligonucleotide
  Target: AGXT; (+) strand; PAM type: YTN; PAM sequence: TTG
ggtgtgaccaggggttgatt

SEQ ID NO: 17823 - DNA, 20 bp, Artificial Sequence
  Description of Artificial Sequence: Synthetic oligonucleotide
  Target: AGXT; (+) strand; PAM type: YTN; PAM sequence: TTG
atttggccactgcaacatcc

SEQ ID NO: 17824 - DNA, 20 bp, Artificial Sequence
  Description of Artificial Sequence: Synthetic oligonucleotide
  Target: AGXT; (+) strand; PAM type: YTN; PAM sequence: TTT
ggccactgcaacatccacac

SEQ ID NO: 17825 - DNA, 20 bp, Artificial Sequence
  Description of Artificial Sequence: Synthetic oligonucleotide
  Target: AGXT; (+) strand; PAM type: YTN; PAM sequence: TTG
gccactgcaacatccacact

SEQ ID NO: 17826 - DNA, 20 bp, Artificial Sequence
  Description of Artificial Sequence: Synthetic oligonucleotide
  Target: AGXT; (+) strand; PAM type: YTN; PAM sequence: CTG
caacatccacactctcagga

SEQ ID NO: 17827 - DNA, 20 bp, Artificial Sequence
  Description of Artificial Sequence: Synthetic oligonucleotide
  Target: AGXT; (+) strand; PAM type: YTN; PAM sequence: CTC
tcaggacactgcaacatcca

SEQ ID NO: 17828 - DNA, 20 bp, Artificial Sequence
  Description of Artificial Sequence: Synthetic oligonucleotide
  Target: AGXT; (+) strand; PAM type: YTN; PAM sequence: CTC
aggacactgcaacatccaca

SEQ ID NO: 17829 - DNA, 20 bp, Artificial Sequence
  Description of Artificial Sequence: Synthetic oligonucleotide
  Target: AGXT; (+) strand; PAM type: YTN; PAM sequence: CTG
caacatccacactctcagga

SEQ ID NO: 17830 - DNA, 20 bp, Artificial Sequence
  Description of Artificial Sequence: Synthetic oligonucleotide
  Target: AGXT; (+) strand; PAM type: YTN; PAM sequence: CTC
tcaggacacaggcggctgag

SEQ ID NO: 17831 - DNA, 20 bp, Artificial Sequence
  Description of Artificial Sequence: Synthetic oligonucleotide
  Target: AGXT; (+) strand; PAM type: YTN; PAM sequence: CTC
aggacacaggcggctgagag

SEQ ID NO: 17832 - DNA, 20 bp, Artificial Sequence
  Description of Artificial Sequence: Synthetic oligonucleotide
  Target: AGXT; (+) strand; PAM type: YTN; PAM sequence: CTG
agagtggcctcaggcccagc

SEQ ID NO: 17833 - DNA, 20 bp, Artificial Sequence
  Description of Artificial Sequence: Synthetic oligonucleotide
  Target: AGXT; (+) strand; PAM type: YTN; PAM sequence: CTC
aggcccagcagctctgcagg

SEQ ID NO: 17834 - DNA, 20 bp, Artificial Sequence
  Description of Artificial Sequence: Synthetic oligonucleotide
  Target: AGXT; (+) strand; PAM type: YTN; PAM sequence: CTC
tgcaggccacgagacaggaa

SEQ ID NO: 17835 - DNA, 20 bp, Artificial Sequence
  Description of Artificial Sequence: Synthetic oligonucleotide
  Target: AGXT; (+) strand; PAM type: YTN; PAM sequence: CTG
caggccacgagacaggaagt

SEQ ID NO: 17836 - DNA, 20 bp, Artificial Sequence
  Description of Artificial Sequence: Synthetic oligonucleotide
  Target: AGXT; (+) strand; PAM type: YTN; PAM sequence: CTA
ctttcatctgggtcctgtgt

SEQ ID NO: 17837 - DNA, 20 bp, Artificial Sequence
  Description of Artificial Sequence: Synthetic oligonucleotide
  Target: AGXT; (+) strand; PAM type: YTN; PAM sequence: CTT
tcatctgggtcctgtgtccc

SEQ ID NO: 17838 - DNA, 20 bp, Artificial Sequence
  Description of Artificial Sequence: Synthetic oligonucleotide
  Target: AGXT; (+) strand; PAM type: YTN; PAM sequence: TTT
catctgggtcctgtgtccca

SEQ ID NO: 17839 - DNA, 20 bp, Artificial Sequence
  Description of Artificial Sequence: Synthetic oligonucleotide
  Target: AGXT; (+) strand; PAM type: YTN; PAM sequence: TTC
atctgggtcctgtgtcccac

SEQ ID NO: 17840 - DNA, 20 bp, Artificial Sequence
  Description of Artificial Sequence: Synthetic oligonucleotide
  Target: AGXT; (+) strand; PAM type: YTN; PAM sequence: CTG
ggtcctgtgtcccacagggc

SEQ ID NO: 17841 - DNA, 20 bp, Artificial Sequence
  Description of Artificial Sequence: Synthetic oligonucleotide
  Target: AGXT; (+) strand; PAM type: YTN; PAM sequence: CTG
tgtcccacagggcccattgc

SEQ ID NO: 17842 - DNA, 20 bp, Artificial Sequence
  Description of Artificial Sequence: Synthetic oligonucleotide
  Target: AGXT; (+) strand; PAM type: YTN; PAM sequence: TTG
ccagccaccagtccagagtc

SEQ ID NO: 17843 - DNA, 20 bp, Artificial Sequence
  Description of Artificial Sequence: Synthetic oligonucleotide
  Target: AGXT; (+) strand; PAM type: YTN; PAM sequence: CTG
cagccagcttcccatgaggt

SEQ ID NO: 17844 - DNA, 20 bp, Artificial Sequence
  Description of Artificial Sequence: Synthetic oligonucleotide
  Target: AGXT; (+) strand; PAM type: YTN; PAM sequence: CTT
cccatgaggttgcaaggccg

SEQ ID NO: 17845 - DNA, 20 bp, Artificial Sequence
  Description of Artificial Sequence: Synthetic oligonucleotide
  Target: AGXT; (+) strand; PAM type: YTN; PAM sequence: TTC
ccatgaggttgcaaggccgt

SEQ ID NO: 17846 - DNA, 20 bp, Artificial Sequence
  Description of Artificial Sequence: Synthetic oligonucleotide
  Target: AGXT; (+) strand; PAM type: YTN; PAM sequence: TTG
caaggccgtgcctgccacgt

SEQ ID NO: 17847 - DNA, 20 bp, Artificial Sequence
  Description of Artificial Sequence: Synthetic oligonucleotide
  Target: AGXT; (+) strand; PAM type: YTN; PAM sequence: CTG
ccacgtttgtcctcctgggt

SEQ ID NO: 17848 - DNA, 20 bp, Artificial Sequence
  Description of Artificial Sequence: Synthetic oligonucleotide
  Target: AGXT; (+) strand; PAM type: YTN; PAM sequence: TTT
gtcctcctgggtccactcat

SEQ ID NO: 17849 - DNA, 20 bp, Artificial Sequence
  Description of Artificial Sequence: Synthetic oligonucleotide
  Target: AGXT; (+) strand; PAM type: YTN; PAM sequence: TTG
tcctcctgggtccactcata

SEQ ID NO: 17850 - DNA, 20 bp, Artificial Sequence
  Description of Artificial Sequence: Synthetic oligonucleotide
  Target: AGXT; (+) strand; PAM type: YTN; PAM sequence: CTC
ctgggtccactcataaagcc

SEQ ID NO: 17851 - DNA, 20 bp, Artificial Sequence
  Description of Artificial Sequence: Synthetic oligonucleotide
  Target: AGXT; (+) strand; PAM type: YTN; PAM sequence: CTG
ggtccactcataaagccact

SEQ ID NO: 17852 - DNA, 20 bp, Artificial Sequence
  Description of Artificial Sequence: Synthetic oligonucleotide
  Target: AGXT; (+) strand; PAM type: YTN; PAM sequence: CTC
ataaagccactgcctagggc

SEQ ID NO: 17853 - DNA, 20 bp, Artificial Sequence
  Description of Artificial Sequence: Synthetic oligonucleotide
  Target: AGXT; (+) strand; PAM type: YTN; PAM sequence: CTG
cctagggctgggttagtgcc

SEQ ID NO: 17854 - DNA, 20 bp, Artificial Sequence
  Description of Artificial Sequence: Synthetic oligonucleotide
  Target: AGXT; (+) strand; PAM type: YTN; PAM sequence: CTA
gggctgggttagtgccaggg

SEQ ID NO: 17855 - DNA, 20 bp, Artificial Sequence
  Description of Artificial Sequence: Synthetic oligonucleotide
  Target: AGXT; (+) strand; PAM type: YTN; PAM sequence: CTG
ggttagtgccagggtgcccc

SEQ ID NO: 17856 - DNA, 20 bp, Artificial Sequence
  Description of Artificial Sequence: Synthetic oligonucleotide
  Target: AGXT; (+) strand; PAM type: YTN; PAM sequence: TTA
gtgccagggtgcccctgtaa

SEQ ID NO: 17857 - DNA, 20 bp, Artificial Sequence
  Description of Artificial Sequence: Synthetic oligonucleotide
  Target: AGXT; (+) strand; PAM type: YTN; PAM sequence: CTG
taagctaaatgccacccgca

SEQ ID NO: 17858 - DNA, 20 bp, Artificial Sequence
  Description of Artificial Sequence: Synthetic oligonucleotide
  Target: AGXT; (+) strand; PAM type: YTN; PAM sequence: CTA
aatgccacccgcacccgcgg

SEQ ID NO: 17859 - DNA, 20 bp, Artificial Sequence
  Description of Artificial Sequence: Synthetic oligonucleotide
  Target: AGXT; (+) strand; PAM type: YTN; PAM sequence: CTC
acacagggaaaggctctagg

SEQ ID NO: 17860 - DNA, 20 bp, Artificial Sequence
  Description of Artificial Sequence: Synthetic oligonucleotide
  Target: AGXT; (+) strand; PAM type: YTN; PAM sequence: CTC
tagggtcgtaaaggtgggtg

SEQ ID NO: 17861 - DNA, 20 bp, Artificial Sequence
  Description of Artificial Sequence: Synthetic oligonucleotide
  Target: AGXT; (+) strand; PAM type: YTN; PAM sequence: CTA
gggtcgtaaaggtgggtggg

SEQ ID NO: 17862 - DNA, 20 bp, Artificial Sequence
  Description of Artificial Sequence: Synthetic oligonucleotide
  Target: AGXT; (+) strand; PAM type: YTN; PAM sequence: CTG
ggcagagaaggaagagaaca

SEQ ID NO: 17863 - DNA, 20 bp, Artificial Sequence
  Description of Artificial Sequence: Synthetic oligonucleotide
  Target: AGXT; (+) strand; PAM type: YTN; PAM sequence: CTG
gcagagtgcagattgcaggg

SEQ ID NO: 17864 - DNA, 20 bp, Artificial Sequence
  Description of Artificial Sequence: Synthetic oligonucleotide
  Target: AGXT; (+) strand; PAM type: YTN; PAM sequence: TTG
caggggcacatgcgcagaga

SEQ ID NO: 17865 - DNA, 20 bp, Artificial Sequence
  Description of Artificial Sequence: Synthetic oligonucleotide
  Target: AGXT; (+) strand; PAM type: YTN; PAM sequence: CTG
ctgctccggggacccacctg

SEQ ID NO: 17866 - DNA, 20 bp, Artificial Sequence
  Description of Artificial Sequence: Synthetic oligonucleotide
  Target: AGXT; (+) strand; PAM type: YTN; PAM sequence: CTG
ctccggggacccacctgggg

SEQ ID NO: 17867 - DNA, 20 bp, Artificial Sequence
  Description of Artificial Sequence: Synthetic oligonucleotide
  Target: AGXT; (+) strand; PAM type: YTN; PAM sequence: CTC
cggggacccacctggggtgg

SEQ ID NO: 17868 - DNA, 20 bp, Artificial Sequence
  Description of Artificial Sequence: Synthetic oligonucleotide
  Target: AGXT; (+) strand; PAM type: YTN; PAM sequence: CTG
gggtggccatgagagctggt

SEQ ID NO: 17869 - DNA, 20 bp, Artificial Sequence
  Description of Artificial Sequence: Synthetic oligonucleotide
  Target: AGXT; (+) strand; PAM type: YTN; PAM sequence: CTG
gtggctggaggccgggagga

SEQ ID NO: 17870 - DNA, 20 bp, Artificial Sequence
  Description of Artificial Sequence: Synthetic oligonucleotide
  Target: AGXT; (+) strand; PAM type: YTN; PAM sequence: CTG
gaggccgggaggacccgtga

SEQ ID NO: 17871 - DNA, 20 bp, Artificial Sequence
  Description of Artificial Sequence: Synthetic oligonucleotide
  Target: AGXT; (+) strand; PAM type: YTN; PAM sequence: CTG
aggggcccagggctggagag

SEQ ID NO: 17872 - DNA, 20 bp, Artificial Sequence
  Description of Artificial Sequence: Synthetic oligonucleotide
  Target: AGXT; (+) strand; PAM type: YTN; PAM sequence: CTG
gagagaccacccctcacctg

SEQ ID NO: 17873 - DNA, 20 bp, Artificial Sequence
  Description of Artificial Sequence: Synthetic oligonucleotide
  Target: AGXT; (+) strand; PAM type: YTN; PAM sequence: CTC
acctgtccagagctgaggca

SEQ ID NO: 17874 - DNA, 20 bp, Artificial Sequence
  Description of Artificial Sequence: Synthetic oligonucleotide
  Target: AGXT; (+) strand; PAM type: YTN; PAM sequence: CTG
tccagagctgaggcaggagc

SEQ ID NO: 17875 - DNA, 20 bp, Artificial Sequence
  Description of Artificial Sequence: Synthetic oligonucleotide
  Target: AGXT; (+) strand; PAM type: YTN; PAM sequence: CTG
aggcaggagcagtgctgcgg

SEQ ID NO: 17876 - DNA, 20 bp, Artificial Sequence
  Description of Artificial Sequence: Synthetic oligonucleotide
  Target: AGXT; (+) strand; PAM type: YTN; PAM sequence: CTG
cggaggatgccaggtcgggg

SEQ ID NO: 17877 - DNA, 20 bp, Artificial Sequence
  Description of Artificial Sequence: Synthetic oligonucleotide
  Target: AGXT; (+) strand; PAM type: YTN; PAM sequence: CTG
gccctgagaggagagggggc

SEQ ID NO: 17878 - DNA, 20 bp, Artificial Sequence
  Description of Artificial Sequence: Synthetic oligonucleotide
  Target: AGXT; (+) strand; PAM type: YTN; PAM sequence: CTG
agaggagagggggcctggga

SEQ ID NO: 17879 - DNA, 20 bp, Artificial Sequence
  Description of Artificial Sequence: Synthetic oligonucleotide
  Target: AGXT; (+) strand; PAM type: YTN; PAM sequence: CTG
ggagccagcaccctgagccc

SEQ ID NO: 17880 - DNA, 20 bp, Artificial Sequence
  Description of Artificial Sequence: Synthetic oligonucleotide
  Target: AGXT; (+) strand; PAM type: YTN; PAM sequence: CTG
agccctggccctgatccact

SEQ ID NO: 17881 - DNA, 20 bp, Artificial Sequence
  Description of Artificial Sequence: Synthetic oligonucleotide
  Target: AGXT; (+) strand; PAM type: YTN; PAM sequence: CTG
gccctgatccactccagccc

SEQ ID NO: 17882 - DNA, 20 bp, Artificial Sequence
  Description of Artificial Sequence: Synthetic oligonucleotide
  Target: AGXT; (+) strand; PAM type: YTN; PAM sequence: CTG
atccactccagccctgtgta

SEQ ID NO: 17883 - DNA, 20 bp, Artificial Sequence
  Description of Artificial Sequence: Synthetic oligonucleotide
  Target: AGXT; (+) strand; PAM type: YTN; PAM sequence: CTC
cagccctgtgtagcccaaca

SEQ ID NO: 17884 - DNA, 20 bp, Artificial Sequence
  Description of Artificial Sequence: Synthetic oligonucleotide
  Target: AGXT; (+) strand; PAM type: YTN; PAM sequence: CTG
tgtagcccaacagcccttcc

SEQ ID NO: 17885 - DNA, 20 bp, Artificial Sequence
  Description of Artificial Sequence: Synthetic oligonucleotide
  Target: AGXT; (+) strand; PAM type: YTN; PAM sequence: CTT
cccctccttgcccagtcccc

SEQ ID NO: 17886 - DNA, 20 bp, Artificial Sequence
  Description of Artificial Sequence: Synthetic oligonucleotide
  Target: AGXT; (+) strand; PAM type: YTN; PAM sequence: TTC
ccctccttgcccagtcccct

SEQ ID NO: 17887 - DNA, 20 bp, Artificial Sequence
  Description of Artificial Sequence: Synthetic oligonucleotide
  Target: AGXT; (+) strand; PAM type: YTN; PAM sequence: CTC
cttgcccagtcccctccccc

SEQ ID NO: 17888 - DNA, 20 bp, Artificial Sequence
  Description of Artificial Sequence: Synthetic oligonucleotide
  Target: AGXT; (+) strand; PAM type: YTN; PAM sequence: CTT
gcccagtcccctccccctgc

SEQ ID NO: 17889 - DNA, 20 bp, Artificial Sequence
  Description of Artificial Sequence: Synthetic oligonucleotide
  Target: AGXT; (+) strand; PAM type: YTN; PAM sequence: TTG
cccagtcccctccccctgca

SEQ ID NO: 17890 - DNA, 20 bp, Artificial Sequence
  Description of Artificial Sequence: Synthetic oligonucleotide
  Target: AGXT; (+) strand; PAM type: YTN; PAM sequence: CTC
cccctgcaaggcactctcca

SEQ ID NO: 17891 - DNA, 20 bp, Artificial Sequence
  Description of Artificial Sequence: Synthetic oligonucleotide
  Target: AGXT; (+) strand; PAM type: YTN; PAM sequence: CTG
caaggcactctccactcttc

SEQ ID NO: 17892 - DNA, 20 bp, Artificial Sequence
  Description of Artificial Sequence: Synthetic oligonucleotide
  Target: AGXT; (+) strand; PAM type: YTN; PAM sequence: CTC
tccactcttctcccccaggg

SEQ ID NO: 17893 - DNA, 20 bp, Artificial Sequence
  Description of Artificial Sequence: Synthetic oligonucleotide
  Target: AGXT; (+) strand; PAM type: YTN; PAM sequence: CTC
cactcttctcccccaggggc

SEQ ID NO: 17894 - DNA, 20 bp, Artificial Sequence
  Description of Artificial Sequence: Synthetic oligonucleotide
  Target: AGXT; (+) strand; PAM type: YTN; PAM sequence: CTC
ttctcccccaggggccacag

SEQ ID NO: 17895 - DNA, 20 bp, Artificial Sequence
  Description of Artificial Sequence: Synthetic oligonucleotide
  Target: AGXT; (+) strand; PAM type: YTN; PAM sequence: CTT
ctcccccaggggccacaggc

SEQ ID NO: 17896 - DNA, 20 bp, Artificial Sequence
  Description of Artificial Sequence: Synthetic oligonucleotide
  Target: AGXT; (+) strand; PAM type: YTN; PAM sequence: TTC
tcccccaggggccacaggca

SEQ ID NO: 17897 - DNA, 20 bp, Artificial Sequence
  Description of Artificial Sequence: Synthetic oligonucleotide
  Target: AGXT; (+) strand; PAM type: YTN; PAM sequence: CTC
ccccaggggccacaggcaga

SEQ ID NO: 17898 - DNA, 20 bp, Artificial Sequence
  Description of Artificial Sequence: Synthetic oligonucleotide
  Target: AGXT; (+) strand; PAM type: YTN; PAM sequence: CTC
ccctctgtctctctgaaccc

SEQ ID NO: 17899 - DNA, 20 bp, Artificial Sequence
  Description of Artificial Sequence: Synthetic oligonucleotide
  Target: AGXT; (+) strand; PAM type: YTN; PAM sequence: CTC
tgtctctctgaaccctcctc

SEQ ID NO: 17900 - DNA, 20 bp, Artificial Sequence
  Description of Artificial Sequence: Synthetic oligonucleotide
  Target: AGXT; (+) strand; PAM type: YTN; PAM sequence: CTG
tctctctgaaccctcctctg

SEQ ID NO: 17901 - DNA, 20 bp, Artificial Sequence
  Description of Artificial Sequence: Synthetic oligonucleotide
  Target: AGXT; (+) strand; PAM type: YTN; PAM sequence: CTC
tctgaaccctcctctgtctc

SEQ ID NO: 17902 - DNA, 20 bp, Artificial Sequence
  Description of Artificial Sequence: Synthetic oligonucleotide
  Target: AGXT; (+) strand; PAM type: YTN; PAM sequence: CTC
tgaaccctcctctgtctctc

SEQ ID NO: 17903 - DNA, 20 bp, Artificial Sequence
  Description of Artificial Sequence: Synthetic oligonucleotide
  Target: AGXT; (+) strand; PAM type: YTN; PAM sequence: CTG
aaccctcctctgtctctccc

SEQ ID NO: 17904 - DNA, 20 bp, Artificial Sequence
  Description of Artificial Sequence: Synthetic oligonucleotide
  Target: AGXT; (+) strand; PAM type: YTN; PAM sequence: CTC
ctctgtctctcccagaccca

SEQ ID NO: 17905 - DNA, 20 bp, Artificial Sequence
  Description of Artificial Sequence: Synthetic oligonucleotide
  Target: AGXT; (+) strand; PAM type: YTN; PAM sequence: CTC
tgtctctcccagacccagat

SEQ ID NO: 17906 - DNA, 20 bp, Artificial Sequence
  Description of Artificial Sequence: Synthetic oligonucleotide
  Target: AGXT; (+) strand; PAM type: YTN; PAM sequence: CTG
tctctcccagacccagatgt

SEQ ID NO: 17907 - DNA, 20 bp, Artificial Sequence
  Description of Artificial Sequence: Synthetic oligonucleotide
  Target: AGXT; (+) strand; PAM type: YTN; PAM sequence: CTC
tcccagacccagatgtttcc

SEQ ID NO: 17908 - DNA, 20 bp, Artificial Sequence
  Description of Artificial Sequence: Synthetic oligonucleotide
  Target: AGXT; (+) strand; PAM type: YTN; PAM sequence: CTC
ccagacccagatgtttcctt

SEQ ID NO: 17909 - DNA, 20 bp, Artificial Sequence
  Description of Artificial Sequence: Synthetic oligonucleotide
  Target: AGXT; (+) strand; PAM type: YTN; PAM sequence: TTT
ccttctgccctggggtagtc

SEQ ID NO: 17910 - DNA, 20 bp, Artificial Sequence
  Description of Artificial Sequence: Synthetic oligonucleotide
  Target: AGXT; (+) strand; PAM type: YTN; PAM sequence: TTC
cttctgccctggggtagtcc

SEQ ID NO: 17911 - DNA, 20 bp, Artificial Sequence
  Description of Artificial Sequence: Synthetic oligonucleotide
  Target: AGXT; (+) strand; PAM type: YTN; PAM sequence: CTT
ctgccctggggtagtcccag

SEQ ID NO: 17912 - DNA, 20 bp, Artificial Sequence
  Description of Artificial Sequence: Synthetic oligonucleotide
  Target: AGXT; (+) strand; PAM type: YTN; PAM sequence: TTC
tgccctggggtagtcccagg

SEQ ID NO: 17913 - DNA, 20 bp, Artificial Sequence
  Description of Artificial Sequence: Synthetic oligonucleotide
  Target: AGXT; (+) strand; PAM type: YTN; PAM sequence: CTG
ccctggggtagtcccaggcc

SEQ ID NO: 17914 - DNA, 20 bp, Artificial Sequence
  Description of Artificial Sequence: Synthetic oligonucleotide
  Target: AGXT; (+) strand; PAM type: YTN; PAM sequence: CTG
gggtagtcccaggccctgcc

SEQ ID NO: 17915 - DNA, 20 bp, Artificial Sequence
  Description of Artificial Sequence: Synthetic oligonucleotide
  Target: AGXT; (+) strand; PAM type: YTN; PAM sequence: CTG
ccccaggcaaagtcaaactg

SEQ ID NO: 17916 - DNA, 20 bp, Artificial Sequence
  Description of Artificial Sequence: Synthetic oligonucleotide
  Target: AGXT; (+) strand; PAM type: YTN; PAM sequence: CTG
ggggctccaggggctcccct

SEQ ID NO: 17917 - DNA, 20 bp, Artificial Sequence
  Description of Artificial Sequence: Synthetic oligonucleotide
  Target: AGXT; (+) strand; PAM type: YTN; PAM sequence: CTC
caggggctcccctgcaccaa

SEQ ID NO: 17918 - DNA, 20 bp, Artificial Sequence
  Description of Artificial Sequence: Synthetic oligonucleotide
  Target: AGXT; (+) strand; PAM type: YTN; PAM sequence: CTC
ccctgcaccaaggcctgcag

SEQ ID NO: 17919 - DNA, 20 bp, Artificial Sequence
  Description of Artificial Sequence: Synthetic oligonucleotide
  Target: AGXT; (+) strand; PAM type: YTN; PAM sequence: CTG
caccaaggcctgcagagtca

SEQ ID NO: 17920 - DNA, 20 bp, Artificial Sequence
  Description of Artificial Sequence: Synthetic oligonucleotide
  Target: AGXT; (+) strand; PAM type: YTN; PAM sequence: CTG
cagagtcaggttcttcctcc

SEQ ID NO: 17921 - DNA, 20 bp, Artificial Sequence
  Description of Artificial Sequence: Synthetic oligonucleotide
  Target: AGXT; (+) strand; PAM type: YTN; PAM sequence: TTC
ttcctcccgcaccacagagg

SEQ ID NO: 17922 - DNA, 20 bp, Artificial Sequence
  Description of Artificial Sequence: Synthetic oligonucleotide
  Target: AGXT; (+) strand; PAM type: YTN; PAM sequence: CTT
cctcccgcaccacagagggc

SEQ ID NO: 17923 - DNA, 20 bp, Artificial Sequence
  Description of Artificial Sequence: Synthetic oligonucleotide
  Target: AGXT; (+) strand; PAM type: YTN; PAM sequence: TTC
ctcccgcaccacagagggcg

SEQ ID NO: 17924 - DNA, 20 bp, Artificial Sequence
  Description of Artificial Sequence: Synthetic oligonucleotide
  Target: AGXT; (+) strand; PAM type: YTN; PAM sequence: CTC
ccgcaccacagagggcgggg

SEQ ID NO: 17925 - DNA, 20 bp, Artificial Sequence
  Description of Artificial Sequence: Synthetic oligonucleotide
  Target: AGXT; (+) strand; PAM type: YTN; PAM sequence: CTT
cctgcccaccccacccatgt

SEQ ID NO: 17926 - DNA, 20 bp, Artificial Sequence
  Description of Artificial Sequence: Synthetic oligonucleotide
  Target: AGXT; (+) strand; PAM type: YTN; PAM sequence: TTC
ctgcccaccccacccatgtc

SEQ ID NO: 17927 - DNA, 20 bp, Artificial Sequence
  Description of Artificial Sequence: Synthetic oligonucleotide
  Target: AGXT; (+) strand; PAM type: YTN; PAM sequence: CTG
cccaccccacccatgtcact

SEQ ID NO: 17928 - DNA, 20 bp, Artificial Sequence
  Description of Artificial Sequence: Synthetic oligonucleotide
  Target: AGXT; (+) strand; PAM type: YTN; PAM sequence: CTG
cccaccagcgccatctccca

SEQ ID NO: 17929 - DNA, 20 bp, Artificial Sequence
  Description of Artificial Sequence: Synthetic oligonucleotide
  Target: AGXT; (+) strand; PAM type: YTN; PAM sequence: CTC
ccacacagggcctggagaac

SEQ ID NO: 17930 - DNA, 20 bp, Artificial Sequence
  Description of Artificial Sequence: Synthetic oligonucleotide
  Target: AGXT; (+) strand; PAM type: YTN; PAM sequence: CTG
gagaacagctggcgccagca

SEQ ID NO: 17931 - DNA, 20 bp, Artificial Sequence
  Description of Artificial Sequence: Synthetic oligonucleotide
  Target: AGXT; (+) strand; PAM type: YTN; PAM sequence: CTG
gcgccagcaccgcgaggccg

SEQ ID NO: 17932 - DNA, 20 bp, Artificial Sequence
  Description of Artificial Sequence: Synthetic oligonucleotide
  Target: AGXT; (+) strand; PAM type: YTN; PAM sequence: CTG
catgggcgcctgcaggcact

SEQ ID NO: 17933 - DNA, 20 bp, Artificial Sequence
  Description of Artificial Sequence: Synthetic oligonucleotide
  Target: AGXT; (+) strand; PAM type: YTN; PAM sequence: CTG
caggcactggggctgcagct

SEQ ID NO: 17934 - DNA, 20 bp, Artificial Sequence
  Description of Artificial Sequence: Synthetic oligonucleotide
  Target: AGXT; (+) strand; PAM type: YTN; PAM sequence: CTG
gggctgcagctcttcgtgaa

SEQ ID NO: 17935 - DNA, 20 bp, Artificial Sequence
  Description of Artificial Sequence: Synthetic oligonucleotide
  Target: AGXT; (+) strand; PAM type: YTN; PAM sequence: CTG
cagctcttcgtgaaggaccc

SEQ ID NO: 17936 - DNA, 20 bp, Artificial Sequence
  Description of Artificial Sequence: Synthetic oligonucleotide
  Target: AGXT; (+) strand; PAM type: YTN; PAM sequence: CTC
ttcgtgaaggacccggtaag

SEQ ID NO: 17937 - DNA, 20 bp, Artificial Sequence
  Description of Artificial Sequence: Synthetic oligonucleotide
  Target: AGXT; (+) strand; PAM type: YTN; PAM sequence: CTT
cgtgaaggacccggtaagga

SEQ ID NO: 17938 - DNA, 20 bp, Artificial Sequence
  Description of Artificial Sequence: Synthetic oligonucleotide
  Target: AGXT; (+) strand; PAM type: YTN; PAM sequence: TTC
gtgaaggacccggtaaggag

SEQ ID NO: 17939 - DNA, 20 bp, Artificial Sequence
  Description of Artificial Sequence: Synthetic oligonucleotide
  Target: AGXT; (+) strand; PAM type: YTN; PAM sequence: CTG
gcattgggcagccctgcacc

SEQ ID NO: 17940 - DNA, 20 bp, Artificial Sequence
  Description of Artificial Sequence: Synthetic oligonucleotide
  Target: AGXT; (+) strand; PAM type: YTN; PAM sequence: TTG
ggcagccctgcacccatggg

SEQ ID NO: 17941 - DNA, 20 bp, Artificial Sequence
  Description of Artificial Sequence: Synthetic oligonucleotide
  Target: AGXT; (+) strand; PAM type: YTN; PAM sequence: CTG
cacccatggggaaggatgag

SEQ ID NO: 17942 - DNA, 20 bp, Artificial Sequence
  Description of Artificial Sequence: Synthetic oligonucleotide
  Target: AGXT; (+) strand; PAM type: YTN; PAM sequence: CTC
ttgcccagccccctcaagag

SEQ ID NO: 17943 - DNA, 20 bp, Artificial Sequence
  Description of Artificial Sequence: Synthetic oligonucleotide
  Target: AGXT; (+) strand; PAM type: YTN; PAM sequence: CTT
gcccagccccctcaagaggg

SEQ ID NO: 17944 - DNA, 20 bp, Artificial Sequence
  Description of Artificial Sequence: Synthetic oligonucleotide
  Target: AGXT; (+) strand; PAM type: YTN; PAM sequence: TTG
cccagccccctcaagaggga

SEQ ID NO: 17945 - DNA, 20 bp, Artificial Sequence
  Description of Artificial Sequence: Synthetic oligonucleotide
  Target: AGXT; (+) strand; PAM type: YTN; PAM sequence: CTC
aagagggacactggctcctg

SEQ ID NO: 17946 - DNA, 20 bp, Artificial Sequence
  Description of Artificial Sequence: Synthetic oligonucleotide
  Target: AGXT; (+) strand; PAM type: YTN; PAM sequence: CTG
gctcctgagaaggagggggc

SEQ ID NO: 17947 - DNA, 20 bp, Artificial Sequence
  Description of Artificial Sequence: Synthetic oligonucleotide
  Target: AGXT; (+) strand; PAM type: YTN; PAM sequence: CTC
ctgagaaggagggggcggct

SEQ ID NO: 17948 - DNA, 20 bp, Artificial Sequence
  Description of Artificial Sequence: Synthetic oligonucleotide
  Target: AGXT; (+) strand; PAM type: YTN; PAM sequence: CTG
agaaggagggggcggctgcc

SEQ ID NO: 17949 - DNA, 20 bp, Artificial Sequence
  Description of Artificial Sequence: Synthetic oligonucleotide
  Target: AGXT; (+) strand; PAM type: YTN; PAM sequence: CTG
cccggtggtgtggcctcggt

SEQ ID NO: 17950 - DNA, 20 bp, Artificial Sequence
  Description of Artificial Sequence: Synthetic oligonucleotide
  Target: AGXT; (+) strand; PAM type: YTN; PAM sequence: CTC
ggtgccagggattagtctcg

SEQ ID NO: 17951 - DNA, 20 bp, Artificial Sequence
  Description of Artificial Sequence: Synthetic oligonucleotide
  Target: AGXT; (+) strand; PAM type: YTN; PAM sequence: TTA
gtctcggcaggagccacgaa

SEQ ID NO: 17952 - DNA, 20 bp, Artificial Sequence
  Description of Artificial Sequence: Synthetic oligonucleotide
  Target: AGXT; (+) strand; PAM type: YTN; PAM sequence: CTC
ggcaggagccacgaagtcac

SEQ ID NO: 17953 - DNA, 20 bp, Artificial Sequence
  Description of Artificial Sequence: Synthetic oligonucleotide
  Target: AGXT; (+) strand; PAM type: YTN; PAM sequence: CTC
ccggcctctgatgcgggatc

SEQ ID NO: 17954 - DNA, 20 bp, Artificial Sequence
  Description of Artificial Sequence: Synthetic oligonucleotide
  Target: AGXT; (+) strand; PAM type: YTN; PAM sequence: CTC
tgatgcgggatctcaggacg

SEQ ID NO: 17955 - DNA, 20 bp, Artificial Sequence
  Description of Artificial Sequence: Synthetic oligonucleotide
  Target: AGXT; (+) strand; PAM type: YTN; PAM sequence: CTG
atgcgggatctcaggacggc

SEQ ID NO: 17956 - DNA, 20 bp, Artificial Sequence
  Description of Artificial Sequence: Synthetic oligonucleotide
  Target: AGXT; (+) strand; PAM type: YTN; PAM sequence: CTC
aggacggcctgtgatctccc

SEQ ID NO: 17957 - DNA, 20 bp, Artificial Sequence
  Description of Artificial Sequence: Synthetic oligonucleotide
  Target: AGXT; (+) strand; PAM type: YTN; PAM sequence: CTG
tgatctcccagtgggaaggt

SEQ ID NO: 17958 - DNA, 20 bp, Artificial Sequence
  Description of Artificial Sequence: Synthetic oligonucleotide
  Target: AGXT; (+) strand; PAM type: YTN; PAM sequence: CTC
ccagtgggaaggtgcccatc

SEQ ID NO: 17959 - DNA, 20 bp, Artificial Sequence
  Description of Artificial Sequence: Synthetic oligonucleotide
  Target: AGXT; (+) strand; PAM type: YTN; PAM sequence: CTC
ctaaggggtggggtccctgc

SEQ ID NO: 17960 - DNA, 20 bp, Artificial Sequence
  Description of Artificial Sequence: Synthetic oligonucleotide
  Target: AGXT; (+) strand; PAM type: YTN; PAM sequence: CTA
aggggtggggtccctgctct

SEQ ID NO: 17961 - DNA, 20 bp, Artificial Sequence
  Description of Artificial Sequence: Synthetic oligonucleotide
  Target: AGXT; (+) strand; PAM type: YTN; PAM sequence: CTG
ctctctcccggccctttctc

SEQ ID NO: 17962 - DNA, 20 bp, Artificial Sequence
  Description of Artificial Sequence: Synthetic oligonucleotide
  Target: AGXT; (+) strand; PAM type: YTN; PAM sequence: CTC
tctcccggccctttctcccc

SEQ ID NO: 17963 - DNA, 20 bp, Artificial Sequence
  Description of Artificial Sequence: Synthetic oligonucleotide
  Target: AGXT; (+) strand; PAM type: YTN; PAM sequence: CTC
tcccggccctttctcccccg

SEQ ID NO: 17964 - DNA, 20 bp, Artificial Sequence
  Description of Artificial Sequence: Synthetic oligonucleotide
  Target: AGXT; (+) strand; PAM type: YTN; PAM sequence: CTC
ccggccctttctcccccggc

SEQ ID NO: 17965 - DNA, 20 bp, Artificial Sequence
  Description of Artificial Sequence: Synthetic oligonucleotide
  Target: AGXT; (+) strand; PAM type: YTN; PAM sequence: CTT
tctcccccggctcctctgga

SEQ ID NO: 17966 - DNA, 20 bp, Artificial Sequence
  Description of Artificial Sequence: Synthetic oligonucleotide
  Target: AGXT; (+) strand; PAM type: YTN; PAM sequence: TTT
ctcccccggctcctctggaa

SEQ ID NO: 17967 - DNA, 20 bp, Artificial Sequence
  Description of Artificial Sequence: Synthetic oligonucleotide
  Target: AGXT; (+) strand; PAM type: YTN; PAM sequence: TTC
tcccccggctcctctggaac

SEQ ID NO: 17968 - DNA, 20 bp, Artificial Sequence
  Description of Artificial Sequence: Synthetic oligonucleotide
  Target: AGXT; (+) strand; PAM type: YTN; PAM sequence: CTC
ccccggctcctctggaacct

SEQ ID NO: 17969 - DNA, 20 bp, Artificial Sequence
  Description of Artificial Sequence: Synthetic oligonucleotide
  Target: AGXT; (+) strand; PAM type: YTN; PAM sequence: CTC
ctctggaacctgaagctggg

SEQ ID NO: 17970 - DNA, 20 bp, Artificial Sequence
  Description of Artificial Sequence: Synthetic oligonucleotide
  Target: AGXT; (+) strand; PAM type: YTN; PAM sequence: CTC
tggaacctgaagctggggca

SEQ ID NO: 17971 - DNA, 20 bp, Artificial Sequence
  Description of Artificial Sequence: Synthetic oligonucleotide
  Target: AGXT; (+) strand; PAM type: YTN; PAM sequence: CTG
gaacctgaagctggggcaga

SEQ ID NO: 17972 - DNA, 20 bp, Artificial Sequence
  Description of Artificial Sequence: Synthetic oligonucleotide
  Target: AGXT; (+) strand; PAM type: YTN; PAM sequence: CTG
aagctggggcagatggtgca

SEQ ID NO: 17973 - DNA, 20 bp, Artificial Sequence
  Description of Artificial Sequence: Synthetic oligonucleotide
  Target: AGXT; (+) strand; PAM type: YTN; PAM sequence: CTG
gggcagatggtgcaggccaa

SEQ ID NO: 17974 - DNA, 20 bp, Artificial Sequence
  Description of Artificial Sequence: Synthetic oligonucleotide
  Target: AGXT; (+) strand; PAM type: YTN; PAM sequence: CTG
tcacaaaggcccgtacaggg

SEQ ID NO: 17975 - DNA, 20 bp, Artificial Sequence
  Description of Artificial Sequence: Synthetic oligonucleotide
  Target: AGXT; (+) strand; PAM type: YTN; PAM sequence: CTC
tcacccacgcactgagccag

SEQ ID NO: 17976 - DNA, 20 bp, Artificial Sequence
  Description of Artificial Sequence: Synthetic oligonucleotide
  Target: AGXT; (+) strand; PAM type: YTN; PAM sequence: CTC
acccacgcactgagccaggc

SEQ ID NO: 17977 - DNA, 20 bp, Artificial Sequence
  Description of Artificial Sequence: Synthetic oligonucleotide
  Target: AGXT; (+) strand; PAM type: YTN; PAM sequence: CTG
agccaggcccctcctgcagg

SEQ ID NO: 17978 - DNA, 20 bp, Artificial Sequence
  Description of Artificial Sequence: Synthetic oligonucleotide
  Target: AGXT; (+) strand; PAM type: YTN; PAM sequence: CTC
ctgcaggcgctccggcttcc

SEQ ID NO: 17979 - DNA, 20 bp, Artificial Sequence
  Description of Artificial Sequence: Synthetic oligonucleotide
  Target: AGXT; (+) strand; PAM type: YTN; PAM sequence: CTG
caggcgctccggcttcccac

SEQ ID NO: 17980 - DNA, 20 bp, Artificial Sequence
  Description of Artificial Sequence: Synthetic oligonucleotide
  Target: AGXT; (+) strand; PAM type: YTN; PAM sequence: CTC
cggcttcccacagtcaccac

SEQ ID NO: 17981 - DNA, 20 bp, Artificial Sequence
  Description of Artificial Sequence: Synthetic oligonucleotide
  Target: AGXT; (+) strand; PAM type: YTN; PAM sequence: CTT
cccacagtcaccactgtggc

SEQ ID NO: 17982 - DNA, 20 bp, Artificial Sequence
  Description of Artificial Sequence: Synthetic oligonucleotide
  Target: AGXT; (+) strand; PAM type: YTN; PAM sequence: TTC
ccacagtcaccactgtggct

SEQ ID NO: 17983 - DNA, 20 bp, Artificial Sequence
  Description of Artificial Sequence: Synthetic oligonucleotide
  Target: AGXT; (+) strand; PAM type: YTN; PAM sequence: CTG
tggctgtacccgctggctat

SEQ ID NO: 17984 - DNA, 20 bp, Artificial Sequence
  Description of Artificial Sequence: Synthetic oligonucleotide
  Target: AGXT; (+) strand; PAM type: YTN; PAM sequence: CTG
tacccgctggctatgactgg

SEQ ID NO: 17985 - DNA, 20 bp, Artificial Sequence
  Description of Artificial Sequence: Synthetic oligonucleotide
  Target: AGXT; (+) strand; PAM type: YTN; PAM sequence: CTG
gctatgactggagagacatc

SEQ ID NO: 17986 - DNA, 20 bp, Artificial Sequence
  Description of Artificial Sequence: Synthetic oligonucleotide
  Target: AGXT; (+) strand; PAM type: YTN; PAM sequence: CTA
tgactggagagacatcgtca

SEQ ID NO: 17987 - DNA, 20 bp, Artificial Sequence
  Description of Artificial Sequence: Synthetic oligonucleotide
  Target: AGXT; (+) strand; PAM type: YTN; PAM sequence: CTG
gagagacatcgtcagctacg

SEQ ID NO: 17988 - DNA, 20 bp, Artificial Sequence
  Description of Artificial Sequence: Synthetic oligonucleotide
  Target: AGXT; (+) strand; PAM type: YTN; PAM sequence: CTA
cgtcatagaccacttcgaca

SEQ ID NO: 17989 - DNA, 20 bp, Artificial Sequence
  Description of Artificial Sequence: Synthetic oligonucleotide
  Target: AGXT; (+) strand; PAM type: YTN; PAM sequence: CTT
cgacattgagatcatgggtg

SEQ ID NO: 17990 - DNA, 20 bp, Artificial Sequence
  Description of Artificial Sequence: Synthetic oligonucleotide
  Target: AGXT; (+) strand; PAM type: YTN; PAM sequence: TTC
gacattgagatcatgggtgg

SEQ ID NO: 17991 - DNA, 20 bp, Artificial Sequence
  Description of Artificial Sequence: Synthetic oligonucleotide
  Target: AGXT; (+) strand; PAM type: YTN; PAM sequence: TTG
agatcatgggtggccttggg

SEQ ID NO: 17992 - DNA, 20 bp, Artificial Sequence
  Description of Artificial Sequence: Synthetic oligonucleotide
  Target: AGXT; (+) strand; PAM type: YTN; PAM sequence: CTT
gggccctccacggggaaggt

SEQ ID NO: 17993 - DNA, 20 bp, Artificial Sequence
  Description of Artificial Sequence: Synthetic oligonucleotide
  Target: AGXT; (+) strand; PAM type: YTN; PAM sequence: TTG
ggccctccacggggaaggtg

SEQ ID NO: 17994 - DNA, 20 bp, Artificial Sequence
  Description of Artificial Sequence: Synthetic oligonucleotide
  Target: AGXT; (+) strand; PAM type: YTN; PAM sequence: CTC
cacggggaaggtgagaggga

SEQ ID NO: 17995 - DNA, 20 bp, Artificial Sequence
  Description of Artificial Sequence: Synthetic oligonucleotide
  Target: AGXT; (+) strand; PAM type: YTN; PAM sequence: CTC
gagggccttttgcagaaacc

SEQ ID NO: 17996 - DNA, 20 bp, Artificial Sequence
  Description of Artificial Sequence: Synthetic oligonucleotide
  Target: AGXT; (+) strand; PAM type: YTN; PAM sequence: CTT
ttgcagaaaccaaacccgcc

SEQ ID NO: 17997 - DNA, 20 bp, Artificial Sequence
  Description of Artificial Sequence: Synthetic oligonucleotide
  Target: AGXT; (+) strand; PAM type: YTN; PAM sequence: TTT
tgcagaaaccaaacccgcca

SEQ ID NO: 17998 - DNA, 20 bp, Artificial Sequence
  Description of Artificial Sequence: Synthetic oligonucleotide
  Target: AGXT; (+) strand; PAM type: YTN; PAM sequence: TTT
gcagaaaccaaacccgccac

SEQ ID NO: 17999 - DNA, 20 bp, Artificial Sequence
  Description of Artificial Sequence: Synthetic oligonucleotide
  Target: AGXT; (+) strand; PAM type: YTN; PAM sequence: TTG
cagaaaccaaacccgccacc

SEQ ID NO: 18000 - DNA, 20 bp, Artificial Sequence
  Description of Artificial Sequence: Synthetic oligonucleotide
  Target: AGXT; (+) strand; PAM type: YTN; PAM sequence: CTC
cttgagcaggactgtgcacc

SEQ ID NO: 18001 - DNA, 20 bp, Artificial Sequence
  Description of Artificial Sequence: Synthetic oligonucleotide
  Target: AGXT; (+) strand; PAM type: YTN; PAM sequence: CTT
gagcaggactgtgcaccagg

SEQ ID NO: 18002 - DNA, 20 bp, Artificial Sequence
  Description of Artificial Sequence: Synthetic oligonucleotide
  Target: AGXT; (+) strand; PAM type: YTN; PAM sequence: TTG
agcaggactgtgcaccaggt

SEQ ID NO: 18003 - DNA, 20 bp, Artificial Sequence
  Description of Artificial Sequence: Synthetic oligonucleotide
  Target: AGXT; (+) strand; PAM type: YTN; PAM sequence: CTG
tgcaccaggtgcaggggagg

SEQ ID NO: 18004 - DNA, 20 bp, Artificial Sequence
  Description of Artificial Sequence: Synthetic oligonucleotide
  Target: AGXT; (+) strand; PAM type: YTN; PAM sequence: TTG
caggagcgtccagaagggcc

SEQ ID NO: 18005 - DNA, 20 bp, Artificial Sequence
  Description of Artificial Sequence: Synthetic oligonucleotide
  Target: AGXT; (+) strand; PAM type: YTN; PAM sequence: CTC
tccaaggggtatccagtaaa

SEQ ID NO: 18006 - DNA, 20 bp, Artificial Sequence
  Description of Artificial Sequence: Synthetic oligonucleotide
  Target: AGXT; (+) strand; PAM type: YTN; PAM sequence: CTC
caaggggtatccagtaaagc

SEQ ID NO: 18007 - DNA, 20 bp, Artificial Sequence
  Description of Artificial Sequence: Synthetic oligonucleotide
  Target: AGXT; (+) strand; PAM type: YTN; PAM sequence: CTG
tcgcccctgctcccacccca

SEQ ID NO: 18008 - DNA, 20 bp, Artificial Sequence
  Description of Artificial Sequence: Synthetic oligonucleotide
  Target: AGXT; (+) strand; PAM type: YTN; PAM sequence: CTG
ctcccaccccagcccactga

SEQ ID NO: 18009 - DNA, 20 bp, Artificial Sequence
  Description of Artificial Sequence: Synthetic oligonucleotide
  Target: AGXT; (+) strand; PAM type: YTN; PAM sequence: CTC
ccaccccagcccactgaggt

SEQ ID NO: 18010 - DNA, 20 bp, Artificial Sequence
  Description of Artificial Sequence: Synthetic oligonucleotide
  Target: AGXT; (+) strand; PAM type: YTN; PAM sequence: CTG
aggtcaccaggtgcagcctt

SEQ ID NO: 18011 - DNA, 20 bp, Artificial Sequence
  Description of Artificial Sequence: Synthetic oligonucleotide
  Target: AGXT; (+) strand; PAM type: YTN; PAM sequence: CTT
tatgattccactcggaacat

SEQ ID NO: 18012 - DNA, 20 bp, Artificial Sequence
  Description of Artificial Sequence: Synthetic oligonucleotide
  Target: AGXT; (+) strand; PAM type: YTN; PAM sequence: TTT
atgattccactcggaacatc

SEQ ID NO: 18013 - DNA, 20 bp, Artificial Sequence
  Description of Artificial Sequence: Synthetic oligonucleotide
  Target: AGXT; (+) strand; PAM type: YTN; PAM sequence: TTA
tgattccactcggaacatcc

SEQ ID NO: 18014 - DNA, 20 bp, Artificial Sequence
  Description of Artificial Sequence: Synthetic oligonucleotide
  Target: AGXT; (+) strand; PAM type: YTN; PAM sequence: TTC
cactcggaacatccttcctt

SEQ ID NO: 18015 - DNA, 20 bp, Artificial Sequence
  Description of Artificial Sequence: Synthetic oligonucleotide
  Target: AGXT; (+) strand; PAM type: YTN; PAM sequence: CTC
ggaacatccttccttccctc

SEQ ID NO: 18016 - DNA, 20 bp, Artificial Sequence
  Description of Artificial Sequence: Synthetic oligonucleotide
  Target: AGXT; (+) strand; PAM type: YTN; PAM sequence: CTT
ccttccctctgaccagaccc

SEQ ID NO: 18017 - DNA, 20 bp, Artificial Sequence
  Description of Artificial Sequence: Synthetic oligonucleotide
  Target: AGXT; (+) strand; PAM type: YTN; PAM sequence: TTC
cttccctctgaccagaccct

SEQ ID NO: 18018 - DNA, 20 bp, Artificial Sequence
  Description of Artificial Sequence: Synthetic oligonucleotide
  Target: AGXT; (+) strand; PAM type: YTN; PAM sequence: CTT
ccctctgaccagaccctgga

SEQ ID NO: 18019 - DNA, 20 bp, Artificial Sequence
  Description of Artificial Sequence: Synthetic oligonucleotide
  Target: AGXT; (+) strand; PAM type: YTN; PAM sequence: TTC
cctctgaccagaccctggaa

SEQ ID NO: 18020 - DNA, 20 bp, Artificial Sequence
  Description of Artificial Sequence: Synthetic oligonucleotide
  Target: AGXT; (+) strand; PAM type: YTN; PAM sequence: CTC
tgaccagaccctggaaccag

SEQ ID NO: 18021 - DNA, 20 bp, Artificial Sequence
  Description of Artificial Sequence: Synthetic oligonucleotide
  Target: AGXT; (+) strand; PAM type: YTN; PAM sequence: CTG
accagaccctggaaccaggc

SEQ ID NO: 18022 - DNA, 20 bp, Artificial Sequence
  Description of Artificial Sequence: Synthetic oligonucleotide
  Target: AGXT; (+) strand; PAM type: YTN; PAM sequence: CTG
gaaccaggccggaagcccca

SEQ ID NO: 18023 - DNA, 20 bp, Artificial Sequence
  Description of Artificial Sequence: Synthetic oligonucleotide
  Target: AGXT; (+) strand; PAM type: YTN; PAM sequence: CTG
ggcctggctgtgtctctgag

SEQ ID NO: 18024 - DNA, 20 bp, Artificial Sequence
  Description of Artificial Sequence: Synthetic oligonucleotide
  Target: AGXT; (+) strand; PAM type: YTN; PAM sequence: CTG
gctgtgtctctgagtggcag

SEQ ID NO: 18025 - DNA, 20 bp, Artificial Sequence
  Description of Artificial Sequence: Synthetic oligonucleotide
  Target: AGXT; (+) strand; PAM type: YTN; PAM sequence: CTG
tgtctctgagtggcagtggg

SEQ ID NO: 18026 - DNA, 20 bp, Artificial Sequence
  Description of Artificial Sequence: Synthetic oligonucleotide
  Target: AGXT; (+) strand; PAM type: YTN; PAM sequence: CTC
tgagtggcagtggggaggga

SEQ ID NO: 18027 - DNA, 20 bp, Artificial Sequence
  Description of Artificial Sequence: Synthetic oligonucleotide
  Target: AGXT; (+) strand; PAM type: YTN; PAM sequence: CTG
agtggcagtggggagggacc

SEQ ID NO: 18028 - DNA, 20 bp, Artificial Sequence
  Description of Artificial Sequence: Synthetic oligonucleotide
  Target: AGXT; (+) strand; PAM type: YTN; PAM sequence: CTT
cactgcaccaccctgtcctc

SEQ ID NO: 18029 - DNA, 20 bp, Artificial Sequence
  Description of Artificial Sequence: Synthetic oligonucleotide
  Target: AGXT; (+) strand; PAM type: YTN; PAM sequence: TTC
actgcaccaccctgtcctcc

SEQ ID NO: 18030 - DNA, 20 bp, Artificial Sequence
  Description of Artificial Sequence: Synthetic oligonucleotide
  Target: AGXT; (+) strand; PAM type: YTN; PAM sequence: CTG
caccaccctgtcctcccgtg

SEQ ID NO: 18031 - DNA, 20 bp, Artificial Sequence
  Description of Artificial Sequence: Synthetic oligonucleotide
  Target: AGXT; (+) strand; PAM type: YTN; PAM sequence: CTG
tcctcccgtgtggctgcggg

SEQ ID NO: 18032 - DNA, 20 bp, Artificial Sequence
  Description of Artificial Sequence: Synthetic oligonucleotide
  Target: AGXT; (+) strand; PAM type: YTN; PAM sequence: CTC
ccgtgtggctgcgggtgcag

SEQ ID NO: 18033 - DNA, 20 bp, Artificial Sequence
  Description of Artificial Sequence: Synthetic oligonucleotide
  Target: AGXT; (+) strand; PAM type: YTN; PAM sequence: CTG
cgggtgcagagggaggagag

SEQ ID NO: 18034 - DNA, 20 bp, Artificial Sequence
  Description of Artificial Sequence: Synthetic oligonucleotide
  Target: AGXT; (+) strand; PAM type: YTN; PAM sequence: CTG
ccctggcctgggtgctcaag

SEQ ID NO: 18035 - DNA, 20 bp, Artificial Sequence
  Description of Artificial Sequence: Synthetic oligonucleotide
  Target: AGXT; (+) strand; PAM type: YTN; PAM sequence: CTG
gcctgggtgctcaagggccc

SEQ ID NO: 18036 - DNA, 20 bp, Artificial Sequence
  Description of Artificial Sequence: Synthetic oligonucleotide
  Target: AGXT; (+) strand; PAM type: YTN; PAM sequence: CTG
ggtgctcaagggccccctct

SEQ ID NO: 18037 - DNA, 20 bp, Artificial Sequence
  Description of Artificial Sequence: Synthetic oligonucleotide
  Target: AGXT; (+) strand; PAM type: YTN; PAM sequence: CTC
aagggccccctctgtgacct

SEQ ID NO: 18038 - DNA, 20 bp, Artificial Sequence
  Description of Artificial Sequence: Synthetic oligonucleotide
  Target: AGXT; (+) strand; PAM type: YTN; PAM sequence: CTC
tgtgacctgcacagggctgt

SEQ ID NO: 18039 - DNA, 20 bp, Artificial Sequence
  Description of Artificial Sequence: Synthetic oligonucleotide
  Target: AGXT; (+) strand; PAM type: YTN; PAM sequence: CTG
tgacctgcacagggctgtca

SEQ ID NO: 18040 - DNA, 20 bp, Artificial Sequence
  Description of Artificial Sequence: Synthetic oligonucleotide
  Target: AGXT; (+) strand; PAM type: YTN; PAM sequence: CTG
cacagggctgtcaactcccc

SEQ ID NO: 18041 - DNA, 20 bp, Artificial Sequence
  Description of Artificial Sequence: Synthetic oligonucleotide
  Target: AGXT; (+) strand; PAM type: YTN; PAM sequence: CTG
tcaactcccctcatggacgc

SEQ ID NO: 18042 - DNA, 20 bp, Artificial Sequence
  Description of Artificial Sequence: Synthetic oligonucleotide
  Target: AGXT; (+) strand; PAM type: YTN; PAM sequence: CTC
ccctcatggacgctgggtgg

SEQ ID NO: 18043 - DNA, 20 bp, Artificial Sequence
  Description of Artificial Sequence: Synthetic oligonucleotide
  Target: AGXT; (+) strand; PAM type: YTN; PAM sequence: CTC
atggacgctgggtgggtggt

SEQ ID NO: 18044 - DNA, 20 bp, Artificial Sequence
  Description of Artificial Sequence: Synthetic oligonucleotide
  Target: AGXT; (+) strand; PAM type: YTN; PAM sequence: CTG
ggtgggtggtcctcactcag

SEQ ID NO: 18045 - DNA, 20 bp, Artificial Sequence
  Description of Artificial Sequence: Synthetic oligonucleotide
  Target: AGXT; (+) strand; PAM type: YTN; PAM sequence: CTC
actcaggtgagcccatcctg

SEQ ID NO: 18046 - DNA, 20 bp, Artificial Sequence
  Description of Artificial Sequence: Synthetic oligonucleotide
  Target: AGXT; (+) strand; PAM type: YTN; PAM sequence: CTC
aggtgagcccatcctggctc

SEQ ID NO: 18047 - DNA, 20 bp, Artificial Sequence
  Description of Artificial Sequence: Synthetic oligonucleotide
  Target: AGXT; (+) strand; PAM type: YTN; PAM sequence: CTG
gctctggccagctgtcggtc

SEQ ID NO: 18048 - DNA, 20 bp, Artificial Sequence
  Description of Artificial Sequence: Synthetic oligonucleotide
  Target: AGXT; (+) strand; PAM type: YTN; PAM sequence: CTC
tggccagctgtcggtcaggg

SEQ ID NO: 18049 - DNA, 20 bp, Artificial Sequence
  Description of Artificial Sequence: Synthetic oligonucleotide
  Target: AGXT; (+) strand; PAM type: YTN; PAM sequence: CTG
gccagctgtcggtcagggtc

SEQ ID NO: 18050 - DNA, 20 bp, Artificial Sequence
  Description of Artificial Sequence: Synthetic oligonucleotide
  Target: AGXT; (+) strand; PAM type: YTN; PAM sequence: CTG
tcggtcagggtcaggcaggt

SEQ ID NO: 18051 - DNA, 20 bp, Artificial Sequence
  Description of Artificial Sequence: Synthetic oligonucleotide
  Target: AGXT; (+) strand; PAM type: YTN; PAM sequence: CTG
acgtcagcccgccctgtgcc

SEQ ID NO: 18052 - DNA, 20 bp, Artificial Sequence
  Description of Artificial Sequence: Synthetic oligonucleotide
  Target: AGXT; (+) strand; PAM type: YTN; PAM sequence: CTG
tgccccccaggtgctgcgga

SEQ ID NO: 18053 - DNA, 20 bp, Artificial Sequence
  Description of Artificial Sequence: Synthetic oligonucleotide
  Target: AGXT; (+) strand; PAM type: YTN; PAM sequence: CTG
cggatcggcctgctgggctg

SEQ ID NO: 18054 - DNA, 20 bp, Artificial Sequence
  Description of Artificial Sequence: Synthetic oligonucleotide
  Target: AGXT; (+) strand; PAM type: YTN; PAM sequence: CTG
ctgggctgcaatgccacccg

SEQ ID NO: 18055 - DNA, 20 bp, Artificial Sequence
  Description of Artificial Sequence: Synthetic oligonucleotide
  Target: AGXT; (+) strand; PAM type: YTN; PAM sequence: CTG
ggctgcaatgccacccgcga

SEQ ID NO: 18056 - DNA, 20 bp, Artificial Sequence
  Description of Artificial Sequence: Synthetic oligonucleotide
  Target: AGXT; (+) strand; PAM type: YTN; PAM sequence: CTG
caatgccacccgcgagaatg

SEQ ID NO: 18057 - DNA, 20 bp, Artificial Sequence
  Description of Artificial Sequence: Synthetic oligonucleotide
  Target: AGXT; (+) strand; PAM type: YTN; PAM sequence: CTG
agggcggccctgcagcactg

SEQ ID NO: 18058 - DNA, 20 bp, Artificial Sequence
  Description of Artificial Sequence: Synthetic oligonucleotide
  Target: AGXT; (+) strand; PAM type: YTN; PAM sequence: CTG
cagcactgccccaagaagaa

SEQ ID NO: 18059 - DNA, 20 bp, Artificial Sequence
  Description of Artificial Sequence: Synthetic oligonucleotide
  Target: AGXT; (+) strand; PAM type: YTN; PAM sequence: CTG
ccccaagaagaagctgtgac

SEQ ID NO: 18060 - DNA, 20 bp, Artificial Sequence
  Description of Artificial Sequence: Synthetic oligonucleotide
  Target: AGXT; (+) strand; PAM type: YTN; PAM sequence: CTG
tgacctgcccactggcacac

SEQ ID NO: 18061 - DNA, 20 bp, Artificial Sequence
  Description of Artificial Sequence: Synthetic oligonucleotide
  Target: AGXT; (+) strand; PAM type: YTN; PAM sequence: CTG
cccactggcacacagctggc

SEQ ID NO: 18062 - DNA, 20 bp, Artificial Sequence
  Description of Artificial Sequence: Synthetic oligonucleotide
  Target: AGXT; (+) strand; PAM type: YTN; PAM sequence: CTG
gcacacagctggcactggca

SEQ ID NO: 18063 - DNA, 20 bp, Artificial Sequence
  Description of Artificial Sequence: Synthetic oligonucleotide
  Target: AGXT; (+) strand; PAM type: YTN; PAM sequence: CTG
gcactggcacacacctgtcc

SEQ ID NO: 18064 - DNA, 20 bp, Artificial Sequence
  Description of Artificial Sequence: Synthetic oligonucleotide
  Target: AGXT; (+) strand; PAM type: YTN; PAM sequence: CTG
gcacacacctgtcccatgcc

SEQ ID NO: 18065 - DNA, 20 bp, Artificial Sequence
  Description of Artificial Sequence: Synthetic oligonucleotide
  Target: AGXT; (+) strand; PAM type: YTN; PAM sequence: CTG
tcccatgcccaccctgaggg

SEQ ID NO: 18066 - DNA, 20 bp, Artificial Sequence
  Description of Artificial Sequence: Synthetic oligonucleotide
  Target: AGXT; (+) strand; PAM type: YTN; PAM sequence: CTG
agggatcaggagcaaacaga

SEQ ID NO: 18067 - DNA, 20 bp, Artificial Sequence
  Description of Artificial Sequence: Synthetic oligonucleotide
  Target: AGXT; (+) strand; PAM type: YTN; PAM sequence: CTG
caaggtcctccaggcctggg

SEQ ID NO: 18068 - DNA, 20 bp, Artificial Sequence
  Description of Artificial Sequence: Synthetic oligonucleotide
  Target: AGXT; (+) strand; PAM type: YTN; PAM sequence: CTC
caggcctggggacaggaaag

SEQ ID NO: 18069 - DNA, 20 bp, Artificial Sequence
  Description of Artificial Sequence: Synthetic oligonucleotide
  Target: AGXT; (+) strand; PAM type: YTN; PAM sequence: CTG
gggacaggaaagccactgac

SEQ ID NO: 18070 - DNA, 20 bp, Artificial Sequence
  Description of Artificial Sequence: Synthetic oligonucleotide
  Target: AGXT; (+) strand; PAM type: YTN; PAM sequence: CTG
acccagcccgggaggcagaa

SEQ ID NO: 18071 - DNA, 20 bp, Artificial Sequence
  Description of Artificial Sequence: Synthetic oligonucleotide
  Target: AGXT; (+) strand; PAM type: YTN; PAM sequence: CTC
cctggccccaggcagccctt

SEQ ID NO: 18072 - DNA, 20 bp, Artificial Sequence
  Description of Artificial Sequence: Synthetic oligonucleotide
  Target: AGXT; (+) strand; PAM type: YTN; PAM sequence: CTG
gccccaggcagcccttttcc

SEQ ID NO: 18073 - DNA, 20 bp, Artificial Sequence
  Description of Artificial Sequence: Synthetic oligonucleotide
  Target: AGXT; (+) strand; PAM type: YTN; PAM sequence: CTT
ttccctccagtggcacctcc

SEQ ID NO: 18074 - DNA, 20 bp, Artificial Sequence
  Description of Artificial Sequence: Synthetic oligonucleotide
  Target: AGXT; (+) strand; PAM type: YTN; PAM sequence: TTT
tccctccagtggcacctcct

SEQ ID NO: 18075 - DNA, 20 bp, Artificial Sequence
  Description of Artificial Sequence: Synthetic oligonucleotide
  Target: AGXT; (+) strand; PAM type: YTN; PAM sequence: TTT
ccctccagtggcacctcctg

SEQ ID NO: 18076 - DNA, 20 bp, Artificial Sequence
  Description of Artificial Sequence: Synthetic oligonucleotide
  Target: AGXT; (+) strand; PAM type: YTN; PAM sequence: TTC
cctccagtggcacctcctgg

SEQ ID NO: 18077 - DNA, 20 bp, Artificial Sequence
  Description of Artificial Sequence: Synthetic oligonucleotide
  Target: AGXT; (+) strand; PAM type: YTN; PAM sequence: CTC
cagtggcacctcctggaaac

SEQ ID NO: 18078 - DNA, 20 bp, Artificial Sequence
  Description of Artificial Sequence: Synthetic oligonucleotide
  Target: AGXT; (+) strand; PAM type: YTN; PAM sequence: CTC
ctggaaacagtccacttggg

SEQ ID NO: 18079 - DNA, 20 bp, Artificial Sequence
  Description of Artificial Sequence: Synthetic oligonucleotide
  Target: AGXT; (+) strand; PAM type: YTN; PAM sequence: CTG
gaaacagtccacttgggcgc

SEQ ID NO: 18080 - DNA, 20 bp, Artificial Sequence
  Description of Artificial Sequence: Synthetic oligonucleotide
  Target: AGXT; (+) strand; PAM type: YTN; PAM sequence: CTT
gggcgcaaaacccagtgcct

SEQ ID NO: 18081 - DNA, 20 bp, Artificial Sequence
  Description of Artificial Sequence: Synthetic oligonucleotide
  Target: AGXT; (+) strand; PAM type: YTN; PAM sequence: TTG
ggcgcaaaacccagtgcctt

SEQ ID NO: 18082 - DNA, 20 bp, Artificial Sequence
  Description of Artificial Sequence: Synthetic oligonucleotide
  Target: AGXT; (+) strand; PAM type: YTN; PAM sequence: CTT
ccaaatgagctgcagtcccc

SEQ ID NO: 18083 - DNA, 20 bp, Artificial Sequence
  Description of Artificial Sequence: Synthetic oligonucleotide
  Target: AGXT; (+) strand; PAM type: YTN; PAM sequence: TTC
caaatgagctgcagtcccca

SEQ ID NO: 18084 - DNA, 20 bp, Artificial Sequence
  Description of Artificial Sequence: Synthetic oligonucleotide
  Target: AGXT; (+) strand; PAM type: YTN; PAM sequence: CTG
cagtccccaggccatgagcc

SEQ ID NO: 18085 - DNA, 20 bp, Artificial Sequence
  Description of Artificial Sequence: Synthetic oligonucleotide
  Target: AGXT; (+) strand; PAM type: YTN; PAM sequence: CTC
ccgggaatgtttaataaagg

SEQ ID NO: 18086 - DNA, 20 bp, Artificial Sequence
  Description of Artificial Sequence: Synthetic oligonucleotide
  Target: AGXT; (+) strand; PAM type: YTN; PAM sequence: TTT
aataaagggcctggccaact

SEQ ID NO: 18087 - DNA, 20 bp, Artificial Sequence
  Description of Artificial Sequence: Synthetic oligonucleotide
  Target: AGXT; (+) strand; PAM type: YTN; PAM sequence: TTA
ataaagggcctggccaactc

SEQ ID NO: 18088 - DNA, 20 bp, Artificial Sequence
  Description of Artificial Sequence: Synthetic oligonucleotide
  Target: AGXT; (+) strand; PAM type: YTN; PAM sequence: CTG
gccaactctcctcactgtgt

SEQ ID NO: 18089 - DNA, 20 bp, Artificial Sequence
  Description of Artificial Sequence: Synthetic oligonucleotide
  Target: AGXT; (+) strand; PAM type: YTN; PAM sequence: CTC
tcctcactgtgtggggtggt

SEQ ID NO: 18090 - DNA, 20 bp, Artificial Sequence
  Description of Artificial Sequence: Synthetic oligonucleotide
  Target: AGXT; (+) strand; PAM type: YTN; PAM sequence: CTC
ctcactgtgtggggtggtct

SEQ ID NO: 18091 - DNA, 20 bp, Artificial Sequence
  Description of Artificial Sequence: Synthetic oligonucleotide
  Target: AGXT; (+) strand; PAM type: YTN; PAM sequence: CTC
actgtgtggggtggtctgtg

SEQ ID NO: 18092 - DNA, 20 bp, Artificial Sequence
  Description of Artificial Sequence: Synthetic oligonucleotide
  Target: AGXT; (+) strand; PAM type: YTN; PAM sequence: CTG
tgtggggtggtctgtgaaag

SEQ ID NO: 18093 - DNA, 20 bp, Artificial Sequence
  Description of Artificial Sequence: Synthetic oligonucleotide
  Target: AGXT; (+) strand; PAM type: YTN; PAM sequence: CTG
tgaaagagtgagaggagagc

SEQ ID NO: 18094 - DNA, 20 bp, Artificial Sequence
  Description of Artificial Sequence: Synthetic oligonucleotide
  Target: AGXT; (+) strand; PAM type: YTN; PAM sequence: CTC
tgctccctgagctgcctgat

SEQ ID NO: 18095 - DNA, 20 bp, Artificial Sequence
  Description of Artificial Sequence: Synthetic oligonucleotide
  Target: AGXT; (+) strand; PAM type: YTN; PAM sequence: CTG
ctccctgagctgcctgattg

SEQ ID NO: 18096 - DNA, 20 bp, Artificial Sequence
  Description of Artificial Sequence: Synthetic oligonucleotide
  Target: AGXT; (+) strand; PAM type: YTN; PAM sequence: CTC
cctgagctgcctgattgtgg

SEQ ID NO: 18097 - DNA, 20 bp, Artificial Sequence
  Description of Artificial Sequence: Synthetic oligonucleotide
  Target: AGXT; (+) strand; PAM type: YTN; PAM sequence: CTG
agctgcctgattgtggactt

SEQ ID NO: 18098 - DNA, 20 bp, Artificial Sequence
  Description of Artificial Sequence: Synthetic oligonucleotide
  Target: AGXT; (+) strand; PAM type: YTN; PAM sequence: CTG
cctgattgtggactttaggg

SEQ ID NO: 18099 - DNA, 20 bp, Artificial Sequence
  Description of Artificial Sequence: Synthetic oligonucleotide
  Target: AGXT; (+) strand; PAM type: YTN; PAM sequence: CTG
attgtggactttagggggac

SEQ ID NO: 18100 - DNA, 20 bp, Artificial Sequence
  Description of Artificial Sequence: Synthetic oligonucleotide
  Target: AGXT; (+) strand; PAM type: YTN; PAM sequence: TTG
tggactttagggggacactc

SEQ ID NO: 18101 - DNA, 20 bp, Artificial Sequence
  Description of Artificial Sequence: Synthetic oligonucleotide
  Target: AGXT; (+) strand; PAM type: YTN; PAM sequence: CTT
tagggggacactcctcatcc

SEQ ID NO: 18102 - DNA, 20 bp, Artificial Sequence
  Description of Artificial Sequence: Synthetic oligonucleotide
  Target: AGXT; (+) strand; PAM type: YTN; PAM sequence: TTT
agggggacactcctcatcct

SEQ ID NO: 18103 - DNA, 20 bp, Artificial Sequence
  Description of Artificial Sequence: Synthetic oligonucleotide
  Target: AGXT; (+) strand; PAM type: YTN; PAM sequence: TTA
gggggacactcctcatcctg

SEQ ID NO: 18104 - DNA, 20 bp, Artificial Sequence
  Description of Artificial Sequence: Synthetic oligonucleotide
  Target: AGXT; (+) strand; PAM type: YTN; PAM sequence: CTC
ctcatcctggagcccacagg

SEQ ID NO: 18105 - DNA, 20 bp, Artificial Sequence
  Description of Artificial Sequence: Synthetic oligonucleotide
  Target: AGXT; (+) strand; PAM type: YTN; PAM sequence: CTC
atcctggagcccacagggta

SEQ ID NO: 18106 - DNA, 20 bp, Artificial Sequence
  Description of Artificial Sequence: Synthetic oligonucleotide
  Target: AGXT; (+) strand; PAM type: YTN; PAM sequence: CTG
gagcccacagggtagatcct

SEQ ID NO: 18107 - DNA, 20 bp, Artificial Sequence
  Description of Artificial Sequence: Synthetic oligonucleotide
  Target: AGXT; (+) strand; PAM type: YTN; PAM sequence: CTC
ccctggaggaggtgctgtca

SEQ ID NO: 18108 - DNA, 20 bp, Artificial Sequence
  Description of Artificial Sequence: Synthetic oligonucleotide
  Target: AGXT; (+) strand; PAM type: YTN; PAM sequence: CTG
gaggaggtgctgtcaccaca

SEQ ID NO: 18109 - DNA, 20 bp, Artificial Sequence
  Description of Artificial Sequence: Synthetic oligonucleotide
  Target: AGXT; (+) strand; PAM type: YTN; PAM sequence: CTG
tcaccacactctagccccag

SEQ ID NO: 18110 - DNA, 20 bp, Artificial Sequence
  Description of Artificial Sequence: Synthetic oligonucleotide
  Target: AGXT; (+) strand; PAM type: YTN; PAM sequence: CTC
tagccccagatgtcacaccc

SEQ ID NO: 18111 - DNA, 20 bp, Artificial Sequence
  Description of Artificial Sequence: Synthetic oligonucleotide
  Target: AGXT; (+) strand; PAM type: YTN; PAM sequence: CTA
gccccagatgtcacaccccc

SEQ ID NO: 18112 - DNA, 20 bp, Artificial Sequence
  Description of Artificial Sequence: Synthetic oligonucleotide
  Target: AGXT; (+) strand; PAM type: YTN; PAM sequence: CTC
acgcaccacatccaggtgaa

SEQ ID NO: 18113 - DNA, 20 bp, Artificial Sequence
  Description of Artificial Sequence: Synthetic oligonucleotide
  Target: AGXT; (+) strand; PAM type: YTN; PAM sequence: CTG
gttggagacccctgtcatgg

SEQ ID NO: 18114 - DNA, 20 bp, Artificial Sequence
  Description of Artificial Sequence: Synthetic oligonucleotide
  Target: AGXT; (+) strand; PAM type: YTN; PAM sequence: TTG
gagacccctgtcatggacaa

SEQ ID NO: 18115 - DNA, 20 bp, Artificial Sequence
  Description of Artificial Sequence: Synthetic oligonucleotide
  Target: AGXT; (+) strand; PAM type: YTN; PAM sequence: CTG
tcatggacaagggtacctgc

SEQ ID NO: 18116 - DNA, 20 bp, Artificial Sequence
  Description of Artificial Sequence: Synthetic oligonucleotide
  Target: AGXT; (+) strand; PAM type: YTN; PAM sequence: CTG
cgtgctggagagcgcacagc

SEQ ID NO: 18117 - DNA, 20 bp, Artificial Sequence
  Description of Artificial Sequence: Synthetic oligonucleotide
  Target: AGXT; (+) strand; PAM type: YTN; PAM sequence: CTG
gagagcgcacagccaggacc

SEQ ID NO: 18118 - DNA, 20 bp, Artificial Sequence
  Description of Artificial Sequence: Synthetic oligonucleotide
  Target: AGXT; (+) strand; PAM type: YTN; PAM sequence: CTG
agcccatgacacgtggaagc

SEQ ID NO: 18119 - DNA, 20 bp, Artificial Sequence
  Description of Artificial Sequence: Synthetic oligonucleotide
  Target: AGXT; (+) strand; PAM type: YTN; PAM sequence: CTC
caatggaaggtcccctatgc

SEQ ID NO: 18120 - DNA, 20 bp, Artificial Sequence
  Description of Artificial Sequence: Synthetic oligonucleotide
  Target: AGXT; (+) strand; PAM type: YTN; PAM sequence: CTA
tgctcccatccagccagtgc

SEQ ID NO: 18121 - DNA, 20 bp, Artificial Sequence
  Description of Artificial Sequence: Synthetic oligonucleotide
  Target: AGXT; (+) strand; PAM type: YTN; PAM sequence: CTC
ccatccagccagtgcccacc

SEQ ID NO: 18122 - DNA, 20 bp, Artificial Sequence
  Description of Artificial Sequence: Synthetic oligonucleotide
  Target: AGXT; (+) strand; PAM type: YTN; PAM sequence: CTC
aactgcctgacttctgtgac

SEQ ID NO: 18123 - DNA, 20 bp, Artificial Sequence
  Description of Artificial Sequence: Synthetic oligonucleotide
  Target: AGXT; (+) strand; PAM type: YTN; PAM sequence: CTG
cctgacttctgtgaccatag

SEQ ID NO: 18124 - DNA, 20 bp, Artificial Sequence
  Description of Artificial Sequence: Synthetic oligonucleotide
  Target: AGXT; (+) strand; PAM type: YTN; PAM sequence: CTG
acttctgtgaccatagatca

SEQ ID NO: 18125 - DNA, 20 bp, Artificial Sequence
  Description of Artificial Sequence: Synthetic oligonucleotide
  Target: AGXT; (+) strand; PAM type: YTN; PAM sequence: CTT
ctgtgaccatagatcagcct

SEQ ID NO: 18126 - DNA, 20 bp, Artificial Sequence
  Description of Artificial Sequence: Synthetic oligonucleotide
  Target: AGXT; (+) strand; PAM type: YTN; PAM sequence: TTC
tgtgaccatagatcagcctg

SEQ ID NO: 18127 - DNA, 20 bp, Artificial Sequence
  Description of Artificial Sequence: Synthetic oligonucleotide
  Target: AGXT; (+) strand; PAM type: YTN; PAM sequence: CTG
tgaccatagatcagcctggc

SEQ ID NO: 18128 - DNA, 20 bp, Artificial Sequence
  Description of Artificial Sequence: Synthetic oligonucleotide
  Target: AGXT; (+) strand; PAM type: YTN; PAM sequence: CTG
gcatatttgaatttatttat

SEQ ID NO: 18129 - DNA, 20 bp, Artificial Sequence
  Description of Artificial Sequence: Synthetic oligonucleotide
  Target: AGXT; (+) strand; PAM type: YTN; PAM sequence: TTT
gaatttatttatttattttg

SEQ ID NO: 18130 - DNA, 20 bp, Artificial Sequence
  Description of Artificial Sequence: Synthetic oligonucleotide
  Target: AGXT; (+) strand; PAM type: YTN; PAM sequence: TTG
aatttatttatttattttga

SEQ ID NO: 18131 - DNA, 20 bp, Artificial Sequence
  Description of Artificial Sequence: Synthetic oligonucleotide
  Target: AGXT; (+) strand; PAM type: YTN; PAM sequence: TTT
atttatttattttgaaacgg

SEQ ID NO: 18132 - DNA, 20 bp, Artificial Sequence
  Description of Artificial Sequence: Synthetic oligonucleotide
  Target: AGXT; (+) strand; PAM type: YTN; PAM sequence: TTA
tttatttattttgaaacgga

SEQ ID NO: 18133 - DNA, 20 bp, Artificial Sequence
  Description of Artificial Sequence: Synthetic oligonucleotide
  Target: AGXT; (+) strand; PAM type: YTN; PAM sequence: TTT
atttattttgaaacggagtt

SEQ ID NO: 18134 - DNA, 20 bp, Artificial Sequence
  Description of Artificial Sequence: Synthetic oligonucleotide
  Target: AGXT; (+) strand; PAM type: YTN; PAM sequence: TTA
tttattttgaaacggagttt

SEQ ID NO: 18135 - DNA, 20 bp, Artificial Sequence
  Description of Artificial Sequence: Synthetic oligonucleotide
  Target: AGXT; (+) strand; PAM type: YTN; PAM sequence: TTT
attttgaaacggagtttcac

SEQ ID NO: 18136 - DNA, 20 bp, Artificial Sequence
  Description of Artificial Sequence: Synthetic oligonucleotide
  Target: AGXT; (+) strand; PAM type: YTN; PAM sequence: TTA
ttttgaaacggagtttcact

SEQ ID NO: 18137 - DNA, 20 bp, Artificial Sequence
  Description of Artificial Sequence: Synthetic oligonucleotide
  Target: AGXT; (+) strand; PAM type: YTN; PAM sequence: TTT
tgaaacggagtttcactctt

SEQ ID NO: 18138 - DNA, 20 bp, Artificial Sequence
  Description of Artificial Sequence: Synthetic oligonucleotide
  Target: AGXT; (+) strand; PAM type: YTN; PAM sequence: TTT
gaaacggagtttcactcttg

SEQ ID NO: 18139 - DNA, 20 bp, Artificial Sequence
  Description of Artificial Sequence: Synthetic oligonucleotide
  Target: AGXT; (+) strand; PAM type: YTN; PAM sequence: TTG
aaacggagtttcactcttgt

SEQ ID NO: 18140 - DNA, 20 bp, Artificial Sequence
  Description of Artificial Sequence: Synthetic oligonucleotide
  Target: AGXT; (+) strand; PAM type: YTN; PAM sequence: TTT
cactcttgttgcccaggctg

SEQ ID NO: 18141 - DNA, 20 bp, Artificial Sequence
  Description of Artificial Sequence: Synthetic oligonucleotide
  Target: AGXT; (+) strand; PAM type: YTN; PAM sequence: TTC
actcttgttgcccaggctgg

SEQ ID NO: 18142 - DNA, 20 bp, Artificial Sequence
  Description of Artificial Sequence: Synthetic oligonucleotide
  Target: AGXT; (+) strand; PAM type: YTN; PAM sequence: CTC
ttgttgcccaggctggagtg

SEQ ID NO: 18143 - DNA, 20 bp, Artificial Sequence
  Description of Artificial Sequence: Synthetic oligonucleotide
  Target: AGXT; (+) strand; PAM type: YTN; PAM sequence: CTT
gttgcccaggctggagtgca

SEQ ID NO: 18144 - DNA, 20 bp, Artificial Sequence
  Description of Artificial Sequence: Synthetic oligonucleotide
  Target: AGXT; (+) strand; PAM type: YTN; PAM sequence: TTG
ttgcccaggctggagtgcag

SEQ ID NO: 18145 - DNA, 20 bp, Artificial Sequence
  Description of Artificial Sequence: Synthetic oligonucleotide
  Target: AGXT; (+) strand; PAM type: YTN; PAM sequence: TTG
cccaggctggagtgcagtgg

SEQ ID NO: 18146 - DNA, 20 bp, Artificial Sequence
  Description of Artificial Sequence: Synthetic oligonucleotide
  Target: AGXT; (+) strand; PAM type: YTN; PAM sequence: CTG
gagtgcagtggcacgatctc

SEQ ID NO: 18147 - DNA, 20 bp, Artificial Sequence
  Description of Artificial Sequence: Synthetic oligonucleotide
  Target: AGXT; (+) strand; PAM type: YTN; PAM sequence: CTC
agctcactacaacctccgcc

SEQ ID NO: 18148 - DNA, 20 bp, Artificial Sequence
  Description of Artificial Sequence: Synthetic oligonucleotide
  Target: AGXT; (+) strand; PAM type: YTN; PAM sequence: CTC
actacaacctccgcctcccg

SEQ ID NO: 18149 - DNA, 20 bp, Artificial Sequence
  Description of Artificial Sequence: Synthetic oligonucleotide
  Target: AGXT; (+) strand; PAM type: YTN; PAM sequence: CTA
caacctccgcctcccgggtt

SEQ ID NO: 18150 - DNA, 20 bp, Artificial Sequence
  Description of Artificial Sequence: Synthetic oligonucleotide
  Target: AGXT; (+) strand; PAM type: YTN; PAM sequence: CTC
cgcctcccgggttcaagcga

SEQ ID NO: 18151 - DNA, 20 bp, Artificial Sequence
  Description of Artificial Sequence: Synthetic oligonucleotide
  Target: AGXT; (+) strand; PAM type: YTN; PAM sequence: CTC
ccgggttcaagcgattctcc

SEQ ID NO: 18152 - DNA, 20 bp, Artificial Sequence
  Description of Artificial Sequence: Synthetic oligonucleotide
  Target: AGXT; (+) strand; PAM type: YTN; PAM sequence: TTC
aagcgattctcctgcctcag

SEQ ID NO: 18153 - DNA, 20 bp, Artificial Sequence
  Description of Artificial Sequence: Synthetic oligonucleotide
  Target: AGXT; (+) strand; PAM type: YTN; PAM sequence: TTC
tcctgcctcaggctccggat

SEQ ID NO: 18154 - DNA, 20 bp, Artificial Sequence
  Description of Artificial Sequence: Synthetic oligonucleotide
  Target: AGXT; (+) strand; PAM type: YTN; PAM sequence: CTC
ctgcctcaggctccggatta

SEQ ID NO: 18155 - DNA, 20 bp, Artificial Sequence
  Description of Artificial Sequence: Synthetic oligonucleotide
  Target: AGXT; (+) strand; PAM type: YTN; PAM sequence: CTG
cctcaggctccggattagct

SEQ ID NO: 18156 - DNA, 20 bp, Artificial Sequence
  Description of Artificial Sequence: Synthetic oligonucleotide
  Target: AGXT; (+) strand; PAM type: YTN; PAM sequence: CTC
aggctccggattagctggga

SEQ ID NO: 18157 - DNA, 20 bp, Artificial Sequence
  Description of Artificial Sequence: Synthetic oligonucleotide
  Target: AGXT; (+) strand; PAM type: YTN; PAM sequence: CTC
cggattagctgggactacag

SEQ ID NO: 18158 - DNA, 20 bp, Artificial Sequence
  Description of Artificial Sequence: Synthetic oligonucleotide
  Target: AGXT; (+) strand; PAM type: YTN; PAM sequence: TTA
gctgggactacaggtgtgca

SEQ ID NO: 18159 - DNA, 20 bp, Artificial Sequence
  Description of Artificial Sequence: Synthetic oligonucleotide
  Target: AGXT; (+) strand; PAM type: YTN; PAM sequence: CTG
ggactacaggtgtgcaccac

SEQ ID NO: 18160 - DNA, 20 bp, Artificial Sequence
  Description of Artificial Sequence: Synthetic oligonucleotide
  Target: AGXT; (+) strand; PAM type: YTN; PAM sequence: CTA
caggtgtgcaccaccatgcc

SEQ ID NO: 18161 - DNA, 20 bp, Artificial Sequence
  Description of Artificial Sequence: Synthetic oligonucleotide
  Target: AGXT; (+) strand; PAM type: YTN; PAM sequence: CTA
atttttgtatttttagtaca

SEQ ID NO: 18162 - DNA, 20 bp, Artificial Sequence
  Description of Artificial Sequence: Synthetic oligonucleotide
  Target: AGXT; (+) strand; PAM type: YTN; PAM sequence: TTT
ttgtatttttagtacagatg

SEQ ID NO: 18163 - DNA, 20 bp, Artificial Sequence
  Description of Artificial Sequence: Synthetic oligonucleotide
  Target: AGXT; (+) strand; PAM type: YTN; PAM sequence: TTT
tgtatttttagtacagatgg

SEQ ID NO: 18164 - DNA, 20 bp, Artificial Sequence
  Description of Artificial Sequence: Synthetic oligonucleotide
  Target: AGXT; (+) strand; PAM type: YTN; PAM sequence: TTT
gtatttttagtacagatggg

SEQ ID NO: 18165 - DNA, 20 bp, Artificial Sequence
  Description of Artificial Sequence: Synthetic oligonucleotide
  Target: AGXT; (+) strand; PAM type: YTN; PAM sequence: TTG
tatttttagtacagatgggg

SEQ ID NO: 18166 - DNA, 20 bp, Artificial Sequence
  Description of Artificial Sequence: Synthetic oligonucleotide
  Target: AGXT; (+) strand; PAM type: YTN; PAM sequence: TTT
ttagtacagatggggtttca

SEQ ID NO: 18167 - DNA, 20 bp, Artificial Sequence
  Description of Artificial Sequence: Synthetic oligonucleotide
  Target: AGXT; (+) strand; PAM type: YTN; PAM sequence: TTT
tagtacagatggggtttcac

SEQ ID NO: 18168 - DNA, 20 bp, Artificial Sequence
  Description of Artificial Sequence: Synthetic oligonucleotide
  Target: AGXT; (+) strand; PAM type: YTN; PAM sequence: TTT
agtacagatggggtttcact

SEQ ID NO: 18169 - DNA, 20 bp, Artificial Sequence
  Description of Artificial Sequence: Synthetic oligonucleotide
  Target: AGXT; (+) strand; PAM type: YTN; PAM sequence: TTA
gtacagatggggtttcacta

SEQ ID NO: 18170 - DNA, 20 bp, Artificial Sequence
  Description of Artificial Sequence: Synthetic oligonucleotide
  Target: AGXT; (+) strand; PAM type: YTN; PAM sequence: TTT
cactatattggccaggctgg

SEQ ID NO: 18171 - DNA, 20 bp, Artificial Sequence
  Description of Artificial Sequence: Synthetic oligonucleotide
  Target: AGXT; (+) strand; PAM type: YTN; PAM sequence: TTC
actatattggccaggctggt

SEQ ID NO: 18172 - DNA, 20 bp, Artificial Sequence
  Description of Artificial Sequence: Synthetic oligonucleotide
  Target: AGXT; (+) strand; PAM type: YTN; PAM sequence: CTA
tattggccaggctggtctcg

SEQ ID NO: 18173 - DNA, 20 bp, Artificial Sequence
  Description of Artificial Sequence: Synthetic oligonucleotide
  Target: AGXT; (+) strand; PAM type: YTN; PAM sequence: TTG
gccaggctggtctcgaactc

SEQ ID NO: 18174 - DNA, 20 bp, Artificial Sequence
  Description of Artificial Sequence: Synthetic oligonucleotide
  Target: AGXT; (+) strand; PAM type: YTN; PAM sequence: CTG
gtctcgaactcctgacctca

SEQ ID NO: 18175 - DNA, 20 bp, Artificial Sequence
  Description of Artificial Sequence: Synthetic oligonucleotide
  Target: AGXT; (+) strand; PAM type: YTN; PAM sequence: CTC
gaactcctgacctcaagtga

SEQ ID NO: 18176 - DNA, 20 bp, Artificial Sequence
  Description of Artificial Sequence: Synthetic oligonucleotide
  Target: AGXT; (+) strand; PAM type: YTN; PAM sequence: CTC
ctgacctcaagtgatccacc

SEQ ID NO: 18177 - DNA, 20 bp, Artificial Sequence
  Description of Artificial Sequence: Synthetic oligonucleotide
  Target: AGXT; (+) strand; PAM type: YTN; PAM sequence: CTG
acctcaagtgatccacctgc

SEQ ID NO: 18178 - DNA, 20 bp, Artificial Sequence
  Description of Artificial Sequence: Synthetic oligonucleotide
  Target: AGXT; (+) strand; PAM type: YTN; PAM sequence: CTC
aagtgatccacctgcctcgg

SEQ ID NO: 18179 - DNA, 20 bp, Artificial Sequence
  Description of Artificial Sequence: Synthetic oligonucleotide
  Target: AGXT; (+) strand; PAM type: YTN; PAM sequence: CTG
cctcggcctcccaaagtgct

SEQ ID NO: 18180 - DNA, 20 bp, Artificial Sequence
  Description of Artificial Sequence: Synthetic oligonucleotide
  Target: AGXT; (+) strand; PAM type: YTN; PAM sequence: CTC
ggcctcccaaagtgctggga

SEQ ID NO: 18181 - DNA, 20 bp, Artificial Sequence
  Description of Artificial Sequence: Synthetic oligonucleotide
  Target: AGXT; (+) strand; PAM type: YTN; PAM sequence: CTC
ccaaagtgctgggattacaa

SEQ ID NO: 18182 - DNA, 20 bp, Artificial Sequence
  Description of Artificial Sequence: Synthetic oligonucleotide
  Target: AGXT; (+) strand; PAM type: YTN; PAM sequence: CTG
ggattacaagcgtgagccac

SEQ ID NO: 18183 - DNA, 20 bp, Artificial Sequence
  Description of Artificial Sequence: Synthetic oligonucleotide
  Target: AGXT; (+) strand; PAM type: YTN; PAM sequence: TTA
caagcgtgagccactgtgcc

SEQ ID NO: 18184 - DNA, 20 bp, Artificial Sequence
  Description of Artificial Sequence: Synthetic oligonucleotide
  Target: AGXT; (+) strand; PAM type: YTN; PAM sequence: CTG
tgcccagccatagttgaatt

SEQ ID NO: 18185 - DNA, 20 bp, Artificial Sequence
  Description of Artificial Sequence: Synthetic oligonucleotide
  Target: AGXT; (+) strand; PAM type: YTN; PAM sequence: TTG
aatttcatggtcagtggaac

SEQ ID NO: 18186 - DNA, 20 bp, Artificial Sequence
  Description of Artificial Sequence: Synthetic oligonucleotide
  Target: AGXT; (+) strand; PAM type: YTN; PAM sequence: TTT
catggtcagtggaacacaca

SEQ ID NO: 18187 - DNA, 20 bp, Artificial Sequence
  Description of Artificial Sequence: Synthetic oligonucleotide
  Target: AGXT; (+) strand; PAM type: YTN; PAM sequence: TTC
atggtcagtggaacacacag

SEQ ID NO: 18188 - DNA, 20 bp, Artificial Sequence
  Description of Artificial Sequence: Synthetic oligonucleotide
  Target: AGXT; (+) strand; PAM type: YTN; PAM sequence: CTC
cactgtgccagcttctttca

SEQ ID NO: 18189 - DNA, 20 bp, Artificial Sequence
  Description of Artificial Sequence: Synthetic oligonucleotide
  Target: AGXT; (+) strand; PAM type: YTN; PAM sequence: CTG
tgccagcttctttcacttac

SEQ ID NO: 18190 - DNA, 20 bp, Artificial Sequence
  Description of Artificial Sequence: Synthetic oligonucleotide
  Target: AGXT; (+) strand; PAM type: YTN; PAM sequence: CTT
ctttcacttactgtttttga

SEQ ID NO: 18191 - DNA, 20 bp, Artificial Sequence
  Description of Artificial Sequence: Synthetic oligonucleotide
  Target: AGXT; (+) strand; PAM type: YTN; PAM sequence: TTC
tttcacttactgtttttgac

SEQ ID NO: 18192 - DNA, 20 bp, Artificial Sequence
  Description of Artificial Sequence: Synthetic oligonucleotide
  Target: AGXT; (+) strand; PAM type: YTN; PAM sequence: CTT
tcacttactgtttttgacac

SEQ ID NO: 18193 - DNA, 20 bp, Artificial Sequence
  Description of Artificial Sequence: Synthetic oligonucleotide
  Target: AGXT; (+) strand; PAM type: YTN; PAM sequence: TTT
cacttactgtttttgacact

SEQ ID NO: 18194 - DNA, 20 bp, Artificial Sequence
  Description of Artificial Sequence: Synthetic oligonucleotide
  Target: AGXT; (+) strand; PAM type: YTN; PAM sequence: TTC
acttactgtttttgacactc

SEQ ID NO: 18195 - DNA, 20 bp, Artificial Sequence
  Description of Artificial Sequence: Synthetic oligonucleotide
  Target: AGXT; (+) strand; PAM type: YTN; PAM sequence: CTT
actgtttttgacactcacat

SEQ ID NO: 18196 - DNA, 20 bp, Artificial Sequence
  Description of Artificial Sequence: Synthetic oligonucleotide
  Target: AGXT; (+) strand; PAM type: YTN; PAM sequence: TTA
ctgtttttgacactcacatg

SEQ ID NO: 18197 - DNA, 20 bp, Artificial Sequence
  Description of Artificial Sequence: Synthetic oligonucleotide
  Target: AGXT; (+) strand; PAM type: YTN; PAM sequence: CTG
tttttgacactcacatgtac

SEQ ID NO: 18198 - DNA, 20 bp, Artificial Sequence
  Description of Artificial Sequence: Synthetic oligonucleotide
  Target: AGXT; (+) strand; PAM type: YTN; PAM sequence: TTT
ttgacactcacatgtaccgt

SEQ ID NO: 18199 - DNA, 20 bp, Artificial Sequence
  Description of Artificial Sequence: Synthetic oligonucleotide
  Target: AGXT; (+) strand; PAM type: YTN; PAM sequence: TTT
tgacactcacatgtaccgtc

SEQ ID NO: 18200 - DNA, 20 bp, Artificial Sequence
  Description of Artificial Sequence: Synthetic oligonucleotide
  Target: AGXT; (+) strand; PAM type: YTN; PAM sequence: TTT
gacactcacatgtaccgtcg

SEQ ID NO: 18201 - DNA, 20 bp, Artificial Sequence
  Description of Artificial Sequence: Synthetic oligonucleotide
  Target: AGXT; (+) strand; PAM type: YTN; PAM sequence: TTG
acactcacatgtaccgtcgt

SEQ ID NO: 18202 - DNA, 20 bp, Artificial Sequence
  Description of Artificial Sequence: Synthetic oligonucleotide
  Target: AGXT; (+) strand; PAM type: YTN; PAM sequence: CTC
acatgtaccgtcgtgggcgc

SEQ ID NO: 18203 - DNA, 20 bp, Artificial Sequence
  Description of Artificial Sequence: Synthetic oligonucleotide
  Target: AGXT; (+) strand; PAM type: YTN; PAM sequence: CTT
tgttgctgagtgccgtcccg

SEQ ID NO: 18204 - DNA, 20 bp, Artificial Sequence
  Description of Artificial Sequence: Synthetic oligonucleotide
  Target: AGXT; (+) strand; PAM type: YTN; PAM sequence: TTT
gttgctgagtgccgtcccgt

SEQ ID NO: 18205 - DNA, 20 bp, Artificial Sequence
  Description of Artificial Sequence: Synthetic oligonucleotide
  Target: AGXT; (+) strand; PAM type: YTN; PAM sequence: TTG
ttgctgagtgccgtcccgtc

SEQ ID NO: 18206 - DNA, 20 bp, Artificial Sequence
  Description of Artificial Sequence: Synthetic oligonucleotide
  Target: AGXT; (+) strand; PAM type: YTN; PAM sequence: TTG
ctgagtgccgtcccgtcata

SEQ ID NO: 18207 - DNA, 20 bp, Artificial Sequence
  Description of Artificial Sequence: Synthetic oligonucleotide
  Target: AGXT; (+) strand; PAM type: YTN; PAM sequence: CTG
agtgccgtcccgtcatatgg

SEQ ID NO: 18208 - DNA, 20 bp, Artificial Sequence
  Description of Artificial Sequence: Synthetic oligonucleotide
  Target: AGXT; (+) strand; PAM type: YTN; PAM sequence: CTT
gttgctgagtgccgtcccgt

SEQ ID NO: 18209 - DNA, 20 bp, Artificial Sequence
  Description of Artificial Sequence: Synthetic oligonucleotide
  Target: AGXT; (+) strand; PAM type: YTN; PAM sequence: TTG
ttgctgagtgccgtcccgtc

SEQ ID NO: 18210 - DNA, 20 bp, Artificial Sequence
  Description of Artificial Sequence: Synthetic oligonucleotide
  Target: AGXT; (+) strand; PAM type: YTN; PAM sequence: TTG
ctgagtgccgtcccgtcata

SEQ ID NO: 18211 - DNA, 20 bp, Artificial Sequence
  Description of Artificial Sequence: Synthetic oligonucleotide
  Target: AGXT; (+) strand; PAM type: YTN; PAM sequence: CTG
agtgccgtcccgtcatatgg

SEQ ID NO: 18212 - DNA, 20 bp, Artificial Sequence
  Description of Artificial Sequence: Synthetic oligonucleotide
  Target: AGXT; (+) strand; PAM type: YTN; PAM sequence: CTC
atgatttgttggttcatcac

SEQ ID NO: 18213 - DNA, 20 bp, Artificial Sequence
  Description of Artificial Sequence: Synthetic oligonucleotide
  Target: AGXT; (+) strand; PAM type: YTN; PAM sequence: TTT
gttggttcatcaccatagtt

SEQ ID NO: 18214 - DNA, 20 bp, Artificial Sequence
  Description of Artificial Sequence: Synthetic oligonucleotide
  Target: AGXT; (+) strand; PAM type: YTN; PAM sequence: TTG
ttggttcatcaccatagttg

SEQ ID NO: 18215 - DNA, 20 bp, Artificial Sequence
  Description of Artificial Sequence: Synthetic oligonucleotide
  Target: AGXT; (+) strand; PAM type: YTN; PAM sequence: TTG
gttcatcaccatagttgagc

SEQ ID NO: 18216 - DNA, 20 bp, Artificial Sequence
  Description of Artificial Sequence: Synthetic oligonucleotide
  Target: AGXT; (+) strand; PAM type: YTN; PAM sequence: TTC
atcaccatagttgagcatct

SEQ ID NO: 18217 - DNA, 20 bp, Artificial Sequence
  Description of Artificial Sequence: Synthetic oligonucleotide
  Target: AGXT; (+) strand; PAM type: YTN; PAM sequence: TTG
agcatctgggttatttctat

SEQ ID NO: 18218 - DNA, 20 bp, Artificial Sequence
  Description of Artificial Sequence: Synthetic oligonucleotide
  Target: AGXT; (+) strand; PAM type: YTN; PAM sequence: CTG
ggttatttctattttggggc

SEQ ID NO: 18219 - DNA, 20 bp, Artificial Sequence
  Description of Artificial Sequence: Synthetic oligonucleotide
  Target: AGXT; (+) strand; PAM type: YTN; PAM sequence: TTA
tttctattttggggctgtta

SEQ ID NO: 18220 - DNA, 20 bp, Artificial Sequence
  Description of Artificial Sequence: Synthetic oligonucleotide
  Target: AGXT; (+) strand; PAM type: YTN; PAM sequence: TTT
ctattttggggctgttatga

SEQ ID NO: 18221 - DNA, 20 bp, Artificial Sequence
  Description of Artificial Sequence: Synthetic oligonucleotide
  Target: AGXT; (+) strand; PAM type: YTN; PAM sequence: TTC
tattttggggctgttatgaa

SEQ ID NO: 18222 - DNA, 20 bp, Artificial Sequence
  Description of Artificial Sequence: Synthetic oligonucleotide
  Target: AGXT; (+) strand; PAM type: YTN; PAM sequence: CTA
ttttggggctgttatgaata

SEQ ID NO: 18223 - DNA, 20 bp, Artificial Sequence
  Description of Artificial Sequence: Synthetic oligonucleotide
  Target: AGXT; (+) strand; PAM type: YTN; PAM sequence: TTT
tggggctgttatgaatacgg

SEQ ID NO: 18224 - DNA, 20 bp, Artificial Sequence
  Description of Artificial Sequence: Synthetic oligonucleotide
  Target: AGXT; (+) strand; PAM type: YTN; PAM sequence: TTT
ggggctgttatgaatacgga

SEQ ID NO: 18225 - DNA, 20 bp, Artificial Sequence
  Description of Artificial Sequence: Synthetic oligonucleotide
  Target: AGXT; (+) strand; PAM type: YTN; PAM sequence: TTG
gggctgttatgaatacggag

SEQ ID NO: 18226 - DNA, 20 bp, Artificial Sequence
  Description of Artificial Sequence: Synthetic oligonucleotide
  Target: AGXT; (+) strand; PAM type: YTN; PAM sequence: CTG
ttatgaatacggaggtagtg

SEQ ID NO: 18227 - DNA, 20 bp, Artificial Sequence
  Description of Artificial Sequence: Synthetic oligonucleotide
  Target: AGXT; (+) strand; PAM type: YTN; PAM sequence: TTA
tgaatacggaggtagtgaaa

SEQ ID NO: 18228 - DNA, 20 bp, Artificial Sequence
  Description of Artificial Sequence: Synthetic oligonucleotide
  Target: AGXT; (+) strand; PAM type: YTN; PAM sequence: TTC
ttactcaagccttcgtgtgg

SEQ ID NO: 18229 - DNA, 20 bp, Artificial Sequence
  Description of Artificial Sequence: Synthetic oligonucleotide
  Target: AGXT; (+) strand; PAM type: YTN; PAM sequence: CTT
actcaagccttcgtgtggcc

SEQ ID NO: 18230 - DNA, 20 bp, Artificial Sequence
  Description of Artificial Sequence: Synthetic oligonucleotide
  Target: AGXT; (+) strand; PAM type: YTN; PAM sequence: TTA
ctcaagccttcgtgtggcca

SEQ ID NO: 18231 - DNA, 20 bp, Artificial Sequence
  Description of Artificial Sequence: Synthetic oligonucleotide
  Target: AGXT; (+) strand; PAM type: YTN; PAM sequence: CTC
aagccttcgtgtggccatat

SEQ ID NO: 18232 - DNA, 20 bp, Artificial Sequence
  Description of Artificial Sequence: Synthetic oligonucleotide
  Target: AGXT; (+) strand; PAM type: YTN; PAM sequence: CTT
cgtgtggccatatattttca

SEQ ID NO: 18233 - DNA, 20 bp, Artificial Sequence
  Description of Artificial Sequence: Synthetic oligonucleotide
  Target: AGXT; (+) strand; PAM type: YTN; PAM sequence: TTC
gtgtggccatatattttcat

SEQ ID NO: 18234 - DNA, 20 bp, Artificial Sequence
  Description of Artificial Sequence: Synthetic oligonucleotide
  Target: AGXT; (+) strand; PAM type: YTN; PAM sequence: TTT
tcatttttcttggataaata

SEQ ID NO: 18235 - DNA, 20 bp, Artificial Sequence
  Description of Artificial Sequence: Synthetic oligonucleotide
  Target: AGXT; (+) strand; PAM type: YTN; PAM sequence: TTT
catttttcttggataaataa

SEQ ID NO: 18236 - DNA, 20 bp, Artificial Sequence
  Description of Artificial Sequence: Synthetic oligonucleotide
  Target: AGXT; (+) strand; PAM type: YTN; PAM sequence: TTC
atttttcttggataaataac

SEQ ID NO: 18237 - DNA, 20 bp, Artificial Sequence
  Description of Artificial Sequence: Synthetic oligonucleotide
  Target: AGXT; (+) strand; PAM type: YTN; PAM sequence: TTT
ttcttggataaataactagg

SEQ ID NO: 18238 - DNA, 20 bp, Artificial Sequence
  Description of Artificial Sequence: Synthetic oligonucleotide
  Target: AGXT; (+) strand; PAM type: YTN; PAM sequence: TTT
tcttggataaataactagga

SEQ ID NO: 18239 - DNA, 20 bp, Artificial Sequence
  Description of Artificial Sequence: Synthetic oligonucleotide
  Target: AGXT; (+) strand; PAM type: YTN; PAM sequence: TTT
cttggataaataactaggag

SEQ ID NO: 18240 - DNA, 20 bp, Artificial Sequence
  Description of Artificial Sequence: Synthetic oligonucleotide
  Target: AGXT; (+) strand; PAM type: YTN; PAM sequence: TTC
ttggataaataactaggagt

SEQ ID NO: 18241 - DNA, 20 bp, Artificial Sequence
  Description of Artificial Sequence: Synthetic oligonucleotide
  Target: AGXT; (+) strand; PAM type: YTN; PAM sequence: CTT
ggataaataactaggagtgg

SEQ ID NO: 18242 - DNA, 20 bp, Artificial Sequence
  Description of Artificial Sequence: Synthetic oligonucleotide
  Target: AGXT; (+) strand; PAM type: YTN; PAM sequence: TTG
gataaataactaggagtgga

SEQ ID NO: 18243 - DNA, 20 bp, Artificial Sequence
  Description of Artificial Sequence: Synthetic oligonucleotide
  Target: AGXT; (+) strand; PAM type: YTN; PAM sequence: CTA
ggagtggaattgcagggtca

SEQ ID NO: 18244 - DNA, 20 bp, Artificial Sequence
  Description of Artificial Sequence: Synthetic oligonucleotide
  Target: AGXT; (+) strand; PAM type: YTN; PAM sequence: TTG
cagggtcatacaataggctt

SEQ ID NO: 18245 - DNA, 20 bp, Artificial Sequence
  Description of Artificial Sequence: Synthetic oligonucleotide
  Target: AGXT; (+) strand; PAM type: YTN; PAM sequence: CTT
aaccttatacgagactgcca

SEQ ID NO: 18246 - DNA, 20 bp, Artificial Sequence
  Description of Artificial Sequence: Synthetic oligonucleotide
  Target: AGXT; (+) strand; PAM type: YTN; PAM sequence: TTA
accttatacgagactgccac

SEQ ID NO: 18247 - DNA, 20 bp, Artificial Sequence
  Description of Artificial Sequence: Synthetic oligonucleotide
  Target: AGXT; (+) strand; PAM type: YTN; PAM sequence: CTT
atacgagactgccacgaaat

SEQ ID NO: 18248 - DNA, 20 bp, Artificial Sequence
  Description of Artificial Sequence: Synthetic oligonucleotide
  Target: AGXT; (+) strand; PAM type: YTN; PAM sequence: TTA
tacgagactgccacgaaatt

SEQ ID NO: 18249 - DNA, 20 bp, Artificial Sequence
  Description of Artificial Sequence: Synthetic oligonucleotide
  Target: AGXT; (+) strand; PAM type: YTN; PAM sequence: CTG
ccacgaaattctccgaagtg

SEQ ID NO: 18250 - DNA, 20 bp, Artificial Sequence
  Description of Artificial Sequence: Synthetic oligonucleotide
  Target: AGXT; (+) strand; PAM type: YTN; PAM sequence: TTC
tccgaagtggctcttccatg

SEQ ID NO: 18251 - DNA, 20 bp, Artificial Sequence
  Description of Artificial Sequence: Synthetic oligonucleotide
  Target: AGXT; (+) strand; PAM type: YTN; PAM sequence: CTC
cgaagtggctcttccatgtt

SEQ ID NO: 18252 - DNA, 20 bp, Artificial Sequence
  Description of Artificial Sequence: Synthetic oligonucleotide
  Target: AGXT; (+) strand; PAM type: YTN; PAM sequence: CTC
ttccatgtttcattcccgca

SEQ ID NO: 18253 - DNA, 20 bp, Artificial Sequence
  Description of Artificial Sequence: Synthetic oligonucleotide
  Target: AGXT; (+) strand; PAM type: YTN; PAM sequence: CTT
ccatgtttcattcccgcagc

SEQ ID NO: 18254 - DNA, 20 bp, Artificial Sequence
  Description of Artificial Sequence: Synthetic oligonucleotide
  Target: AGXT; (+) strand; PAM type: YTN; PAM sequence: TTC
catgtttcattcccgcagct

SEQ ID NO: 18255 - DNA, 20 bp, Artificial Sequence
  Description of Artificial Sequence: Synthetic oligonucleotide
  Target: AGXT; (+) strand; PAM type: YTN; PAM sequence: TTT
cattcccgcagctacagcgt

SEQ ID NO: 18256 - DNA, 20 bp, Artificial Sequence
  Description of Artificial Sequence: Synthetic oligonucleotide
  Target: AGXT; (+) strand; PAM type: YTN; PAM sequence: TTC
attcccgcagctacagcgtc

SEQ ID NO: 18257 - DNA, 20 bp, Artificial Sequence
  Description of Artificial Sequence: Synthetic oligonucleotide
  Target: AGXT; (+) strand; PAM type: YTN; PAM sequence: TTC
ccgcagctacagcgtccagg

SEQ ID NO: 18258 - DNA, 20 bp, Artificial Sequence
  Description of Artificial Sequence: Synthetic oligonucleotide
  Target: AGXT; (+) strand; PAM type: YTN; PAM sequence: CTA
cagcgtccagggtgctccac

SEQ ID NO: 18259 - DNA, 20 bp, Artificial Sequence
  Description of Artificial Sequence: Synthetic oligonucleotide
  Target: AGXT; (+) strand; PAM type: YTN; PAM sequence: CTC
cacgtcctcacccacactcc

SEQ ID NO: 18260 - DNA, 20 bp, Artificial Sequence
  Description of Artificial Sequence: Synthetic oligonucleotide
  Target: AGXT; (+) strand; PAM type: YTN; PAM sequence: CTC
acccacactccatgttgtct

SEQ ID NO: 18261 - DNA, 20 bp, Artificial Sequence
  Description of Artificial Sequence: Synthetic oligonucleotide
  Target: AGXT; (+) strand; PAM type: YTN; PAM sequence: CTC
catgttgtctttttttgcta

SEQ ID NO: 18262 - DNA, 20 bp, Artificial Sequence
  Description of Artificial Sequence: Synthetic oligonucleotide
  Target: AGXT; (+) strand; PAM type: YTN; PAM sequence: TTG
tctttttttgctagggggtg

SEQ ID NO: 18263 - DNA, 20 bp, Artificial Sequence
  Description of Artificial Sequence: Synthetic oligonucleotide
  Target: AGXT; (+) strand; PAM type: YTN; PAM sequence: CTT
tttttgctagggggtgtaaa

SEQ ID NO: 18264 - DNA, 20 bp, Artificial Sequence
  Description of Artificial Sequence: Synthetic oligonucleotide
  Target: AGXT; (+) strand; PAM type: YTN; PAM sequence: TTT
ttttgctagggggtgtaaaa

SEQ ID NO: 18265 - DNA, 20 bp, Artificial Sequence
  Description of Artificial Sequence: Synthetic oligonucleotide
  Target: AGXT; (+) strand; PAM type: YTN; PAM sequence: TTT
tttgctagggggtgtaaaat

SEQ ID NO: 18266 - DNA, 20 bp, Artificial Sequence
  Description of Artificial Sequence: Synthetic oligonucleotide
  Target: AGXT; (+) strand; PAM type: YTN; PAM sequence: TTT
ttgctagggggtgtaaaatc

SEQ ID NO: 18267 - DNA, 20 bp, Artificial Sequence
  Description of Artificial Sequence: Synthetic oligonucleotide
  Target: AGXT; (+) strand; PAM type: YTN; PAM sequence: TTT
tgctagggggtgtaaaatcc

SEQ ID NO: 18268 - DNA, 20 bp, Artificial Sequence
  Description of Artificial Sequence: Synthetic oligonucleotide
  Target: AGXT; (+) strand; PAM type: YTN; PAM sequence: TTT
gctagggggtgtaaaatcct

SEQ ID NO: 18269 - DNA, 20 bp, Artificial Sequence
  Description of Artificial Sequence: Synthetic oligonucleotide
  Target: AGXT; (+) strand; PAM type: YTN; PAM sequence: TTG
ctagggggtgtaaaatcctg

SEQ ID NO: 18270 - DNA, 20 bp, Artificial Sequence
  Description of Artificial Sequence: Synthetic oligonucleotide
  Target: AGXT; (+) strand; PAM type: YTN; PAM sequence: CTA
gggggtgtaaaatcctgtct

SEQ ID NO: 18271 - DNA, 20 bp, Artificial Sequence
  Description of Artificial Sequence: Synthetic oligonucleotide
  Target: AGXT; (+) strand; PAM type: YTN; PAM sequence: CTG
tctgatttggttttagtttg

SEQ ID NO: 18272 - DNA, 20 bp, Artificial Sequence
  Description of Artificial Sequence: Synthetic oligonucleotide
  Target: AGXT; (+) strand; PAM type: YTN; PAM sequence: CTG
atttggttttagtttgcatt

SEQ ID NO: 18273 - DNA, 20 bp, Artificial Sequence
  Description of Artificial Sequence: Synthetic oligonucleotide
  Target: AGXT; (+) strand; PAM type: YTN; PAM sequence: TTT
ggttttagtttgcatttccc

SEQ ID NO: 18274 - DNA, 20 bp, Artificial Sequence
  Description of Artificial Sequence: Synthetic oligonucleotide
  Target: AGXT; (+) strand; PAM type: YTN; PAM sequence: TTG
gttttagtttgcatttccct

SEQ ID NO: 18275 - DNA, 20 bp, Artificial Sequence
  Description of Artificial Sequence: Synthetic oligonucleotide
  Target: AGXT; (+) strand; PAM type: YTN; PAM sequence: TTT
tagtttgcatttccctgatg

SEQ ID NO: 18276 - DNA, 20 bp, Artificial Sequence
  Description of Artificial Sequence: Synthetic oligonucleotide
  Target: AGXT; (+) strand; PAM type: YTN; PAM sequence: TTT
agtttgcatttccctgatgc

SEQ ID NO: 18277 - DNA, 20 bp, Artificial Sequence
  Description of Artificial Sequence: Synthetic oligonucleotide
  Target: AGXT; (+) strand; PAM type: YTN; PAM sequence: TTA
gtttgcatttccctgatgcc

SEQ ID NO: 18278 - DNA, 20 bp, Artificial Sequence
  Description of Artificial Sequence: Synthetic oligonucleotide
  Target: AGXT; (+) strand; PAM type: YTN; PAM sequence: TTT
gcatttccctgatgcctatt

SEQ ID NO: 18279 - DNA, 20 bp, Artificial Sequence
  Description of Artificial Sequence: Synthetic oligonucleotide
  Target: AGXT; (+) strand; PAM type: YTN; PAM sequence: TTG
catttccctgatgcctattg

SEQ ID NO: 18280 - DNA, 20 bp, Artificial Sequence
  Description of Artificial Sequence: Synthetic oligonucleotide
  Target: AGXT; (+) strand; PAM type: YTN; PAM sequence: TTT
ccctgatgcctattgatgtt

SEQ ID NO: 18281 - DNA, 20 bp, Artificial Sequence
  Description of Artificial Sequence: Synthetic oligonucleotide
  Target: AGXT; (+) strand; PAM type: YTN; PAM sequence: TTC
cctgatgcctattgatgttg

SEQ ID NO: 18282 - DNA, 20 bp, Artificial Sequence
  Description of Artificial Sequence: Synthetic oligonucleotide
  Target: AGXT; (+) strand; PAM type: YTN; PAM sequence: CTG
atgcctattgatgttgagca

SEQ ID NO: 18283 - DNA, 20 bp, Artificial Sequence
  Description of Artificial Sequence: Synthetic oligonucleotide
  Target: AGXT; (+) strand; PAM type: YTN; PAM sequence: CTA
ttgatgttgagcaacttctc

SEQ ID NO: 18284 - DNA, 20 bp, Artificial Sequence
  Description of Artificial Sequence: Synthetic oligonucleotide
  Target: AGXT; (+) strand; PAM type: YTN; PAM sequence: TTG
atgttgagcaacttctcatg

SEQ ID NO: 18285 - DNA, 20 bp, Artificial Sequence
  Description of Artificial Sequence: Synthetic oligonucleotide
  Target: AGXT; (+) strand; PAM type: YTN; PAM sequence: TTG
agcaacttctcatgagctat

SEQ ID NO: 18286 - DNA, 20 bp, Artificial Sequence
  Description of Artificial Sequence: Synthetic oligonucleotide
  Target: AGXT; (+) strand; PAM type: YTN; PAM sequence: CTT
ctcatgagctatcggccgtt

SEQ ID NO: 18287 - DNA, 20 bp, Artificial Sequence
  Description of Artificial Sequence: Synthetic oligonucleotide
  Target: AGXT; (+) strand; PAM type: YTN; PAM sequence: TTC
tcatgagctatcggccgttt

SEQ ID NO: 18288 - DNA, 20 bp, Artificial Sequence
  Description of Artificial Sequence: Synthetic oligonucleotide
  Target: AGXT; (+) strand; PAM type: YTN; PAM sequence: CTC
atgagctatcggccgtttgt

SEQ ID NO: 18289 - DNA, 20 bp, Artificial Sequence
  Description of Artificial Sequence: Synthetic oligonucleotide
  Target: AGXT; (+) strand; PAM type: YTN; PAM sequence: CTA
tcggccgtttgtagatcttc

SEQ ID NO: 18290 - DNA, 20 bp, Artificial Sequence
  Description of Artificial Sequence: Synthetic oligonucleotide
  Target: AGXT; (+) strand; PAM type: YTN; PAM sequence: TTT
gtagatcttctgaaaagtgt

SEQ ID NO: 18291 - DNA, 20 bp, Artificial Sequence
  Description of Artificial Sequence: Synthetic oligonucleotide
  Target: AGXT; (+) strand; PAM type: YTN; PAM sequence: TTG
tagatcttctgaaaagtgtc

SEQ ID NO: 18292 - DNA, 20 bp, Artificial Sequence
  Description of Artificial Sequence: Synthetic oligonucleotide
  Target: AGXT; (+) strand; PAM type: YTN; PAM sequence: CTT
ctgaaaagtgtcagttcaaa

SEQ ID NO: 18293 - DNA, 20 bp, Artificial Sequence
  Description of Artificial Sequence: Synthetic oligonucleotide
  Target: AGXT; (+) strand; PAM type: YTN; PAM sequence: TTC
tgaaaagtgtcagttcaaat

SEQ ID NO: 18294 - DNA, 20 bp, Artificial Sequence
  Description of Artificial Sequence: Synthetic oligonucleotide
  Target: AGXT; (+) strand; PAM type: YTN; PAM sequence: CTG
aaaagtgtcagttcaaatat

SEQ ID NO: 18295 - DNA, 20 bp, Artificial Sequence
  Description of Artificial Sequence: Synthetic oligonucleotide
  Target: AGXT; (+) strand; PAM type: YTN; PAM sequence: TTC
aaatattttgttcatatttg

SEQ ID NO: 18296 - DNA, 20 bp, Artificial Sequence
  Description of Artificial Sequence: Synthetic oligonucleotide
  Target: AGXT; (+) strand; PAM type: YTN; PAM sequence: TTT
tgttcatatttggattttta

SEQ ID NO: 18297 - DNA, 20 bp, Artificial Sequence
  Description of Artificial Sequence: Synthetic oligonucleotide
  Target: AGXT; (+) strand; PAM type: YTN; PAM sequence: TTT
gttcatatttggatttttat

SEQ ID NO: 18298 - DNA, 20 bp, Artificial Sequence
  Description of Artificial Sequence: Synthetic oligonucleotide
  Target: AGXT; (+) strand; PAM type: YTN; PAM sequence: TTG
ttcatatttggatttttatc

SEQ ID NO: 18299 - DNA, 20 bp, Artificial Sequence
  Description of Artificial Sequence: Synthetic oligonucleotide
  Target: AGXT; (+) strand; PAM type: YTN; PAM sequence: TTC
atatttggatttttatcttc

SEQ ID NO: 18300 - DNA, 20 bp, Artificial Sequence
  Description of Artificial Sequence: Synthetic oligonucleotide
  Target: AGXT; (+) strand; PAM type: YTN; PAM sequence: TTT
ggatttttatcttcttattg

SEQ ID NO: 18301 - DNA, 20 bp, Artificial Sequence
  Description of Artificial Sequence: Synthetic oligonucleotide
  Target: AGXT; (+) strand; PAM type: YTN; PAM sequence: TTG
gatttttatcttcttattgt

SEQ ID NO: 18302 - DNA, 20 bp, Artificial Sequence
  Description of Artificial Sequence: Synthetic oligonucleotide
  Target: AGXT; (+) strand; PAM type: YTN; PAM sequence: TTT
ttatcttcttattgtcaatg

SEQ ID NO: 18303 - DNA, 20 bp, Artificial Sequence
  Description of Artificial Sequence: Synthetic oligonucleotide
  Target: AGXT; (+) strand; PAM type: YTN; PAM sequence: TTT
tatcttcttattgtcaatgt

SEQ ID NO: 18304 - DNA, 20 bp, Artificial Sequence
  Description of Artificial Sequence: Synthetic oligonucleotide
  Target: AGXT; (+) strand; PAM type: YTN; PAM sequence: TTT
atcttcttattgtcaatgtg

SEQ ID NO: 18305 - DNA, 20 bp, Artificial Sequence
  Description of Artificial Sequence: Synthetic oligonucleotide
  Target: AGXT; (+) strand; PAM type: YTN; PAM sequence: TTA
tcttcttattgtcaatgtgt

SEQ ID NO: 18306 - DNA, 20 bp, Artificial Sequence
  Description of Artificial Sequence: Synthetic oligonucleotide
  Target: AGXT; (+) strand; PAM type: YTN; PAM sequence: CTT
cttattgtcaatgtgtgatc

SEQ ID NO: 18307 - DNA, 20 bp, Artificial Sequence
  Description of Artificial Sequence: Synthetic oligonucleotide
  Target: AGXT; (+) strand; PAM type: YTN; PAM sequence: TTC
ttattgtcaatgtgtgatca

SEQ ID NO: 18308 - DNA, 20 bp, Artificial Sequence
  Description of Artificial Sequence: Synthetic oligonucleotide
  Target: AGXT; (+) strand; PAM type: YTN; PAM sequence: CTT
attgtcaatgtgtgatcatt

SEQ ID NO: 18309 - DNA, 20 bp, Artificial Sequence
  Description of Artificial Sequence: Synthetic oligonucleotide
  Target: AGXT; (+) strand; PAM type: YTN; PAM sequence: TTA
ttgtcaatgtgtgatcattt

SEQ ID NO: 18310 - DNA, 20 bp, Artificial Sequence
  Description of Artificial Sequence: Synthetic oligonucleotide
  Target: AGXT; (+) strand; PAM type: YTN; PAM sequence: TTG
tcaatgtgtgatcattttaa

SEQ ID NO: 18311 - DNA, 20 bp, Artificial Sequence
  Description of Artificial Sequence: Synthetic oligonucleotide
  Target: AGXT; (+) strand; PAM type: YTN; PAM sequence: TTT
taaaatatattctagatact

SEQ ID NO: 18312 - DNA, 20 bp, Artificial Sequence
  Description of Artificial Sequence: Synthetic oligonucleotide
  Target: AGXT; (+) strand; PAM type: YTN; PAM sequence: TTT
aaaatatattctagatacta

SEQ ID NO: 18313 - DNA, 20 bp, Artificial Sequence
  Description of Artificial Sequence: Synthetic oligonucleotide
  Target: AGXT; (+) strand; PAM type: YTN; PAM sequence: TTA
aaatatattctagatactat

SEQ ID NO: 18314 - DNA, 20 bp, Artificial Sequence
  Description of Artificial Sequence: Synthetic oligonucleotide
  Target: AGXT; (+) strand; PAM type: YTN; PAM sequence: TTC
tagatactatcagatacgtg

SEQ ID NO: 18315 - DNA, 20 bp, Artificial Sequence
  Description of Artificial Sequence: Synthetic oligonucleotide
  Target: AGXT; (+) strand; PAM type: YTN; PAM sequence: CTA
gatactatcagatacgtgtg

SEQ ID NO: 18316 - DNA, 20 bp, Artificial Sequence
  Description of Artificial Sequence: Synthetic oligonucleotide
  Target: AGXT; (+) strand; PAM type: YTN; PAM sequence: CTA
tcagatacgtgtggcatgaa

SEQ ID NO: 18317 - DNA, 20 bp, Artificial Sequence
  Description of Artificial Sequence: Synthetic oligonucleotide
  Target: AGXT; (+) strand; PAM type: YTN; PAM sequence: TTT
cctccctctctgtggcttac

SEQ ID NO: 18318 - DNA, 20 bp, Artificial Sequence
  Description of Artificial Sequence: Synthetic oligonucleotide
  Target: AGXT; (+) strand; PAM type: YTN; PAM sequence: TTC
ctccctctctgtggcttacc

SEQ ID NO: 18319 - DNA, 20 bp, Artificial Sequence
  Description of Artificial Sequence: Synthetic oligonucleotide
  Target: AGXT; (+) strand; PAM type: YTN; PAM sequence: CTC
cctctctgtggcttacctgt

SEQ ID NO: 18320 - DNA, 20 bp, Artificial Sequence
  Description of Artificial Sequence: Synthetic oligonucleotide
  Target: AGXT; (+) strand; PAM type: YTN; PAM sequence: CTC
tctgtggcttacctgttcat

SEQ ID NO: 18321 - DNA, 20 bp, Artificial Sequence
  Description of Artificial Sequence: Synthetic oligonucleotide
  Target: AGXT; (+) strand; PAM type: YTN; PAM sequence: CTC
tgtggcttacctgttcattt

SEQ ID NO: 18322 - DNA, 20 bp, Artificial Sequence
  Description of Artificial Sequence: Synthetic oligonucleotide
  Target: AGXT; (+) strand; PAM type: YTN; PAM sequence: CTG
tggcttacctgttcattttc

SEQ ID NO: 18323 - DNA, 20 bp, Artificial Sequence
  Description of Artificial Sequence: Synthetic oligonucleotide
  Target: AGXT; (+) strand; PAM type: YTN; PAM sequence: CTT
acctgttcattttcttttct

SEQ ID NO: 18324 - DNA, 20 bp, Artificial Sequence
  Description of Artificial Sequence: Synthetic oligonucleotide
  Target: AGXT; (+) strand; PAM type: YTN; PAM sequence: TTA
cctgttcattttcttttctt

SEQ ID NO: 18325 - DNA, 20 bp, Artificial Sequence
  Description of Artificial Sequence: Synthetic oligonucleotide
  Target: AGXT; (+) strand; PAM type: YTN; PAM sequence: CTG
ttcattttcttttctttttt

SEQ ID NO: 18326 - DNA, 20 bp, Artificial Sequence
  Description of Artificial Sequence: Synthetic oligonucleotide
  Target: AGXT; (+) strand; PAM type: YTN; PAM sequence: TTC
attttcttttcttttttctt

SEQ ID NO: 18327 - DNA, 20 bp, Artificial Sequence
  Description of Artificial Sequence: Synthetic oligonucleotide
  Target: AGXT; (+) strand; PAM type: YTN; PAM sequence: TTT
tcttttcttttttctttctt

SEQ ID NO: 18328 - DNA, 20 bp, Artificial Sequence
  Description of Artificial Sequence: Synthetic oligonucleotide
  Target: AGXT; (+) strand; PAM type: YTN; PAM sequence: TTT
cttttcttttttctttcttt

SEQ ID NO: 18329 - DNA, 20 bp, Artificial Sequence
  Description of Artificial Sequence: Synthetic oligonucleotide
  Target: AGXT; (+) strand; PAM type: YTN; PAM sequence: TTC
ttttcttttttctttctttc

SEQ ID NO: 18330 - DNA, 20 bp, Artificial Sequence
  Description of Artificial Sequence: Synthetic oligonucleotide
  Target: AGXT; (+) strand; PAM type: YTN; PAM sequence: CTT
ttcttttttctttctttctt

SEQ ID NO: 18331 - DNA, 20 bp, Artificial Sequence
  Description of Artificial Sequence: Synthetic oligonucleotide
  Target: AGXT; (+) strand; PAM type: YTN; PAM sequence: TTT
tcttttttctttctttcttt

SEQ ID NO: 18332 - DNA, 20 bp, Artificial Sequence
  Description of Artificial Sequence: Synthetic oligonucleotide
  Target: AGXT; (+) strand; PAM type: YTN; PAM sequence: TTT
cttttttctttctttctttt

SEQ ID NO: 18333 - DNA, 20 bp, Artificial Sequence
  Description of Artificial Sequence: Synthetic oligonucleotide
  Target: AGXT; (+) strand; PAM type: YTN; PAM sequence: TTC
ttttttctttctttcttttt

SEQ ID NO: 18334 - DNA, 20 bp, Artificial Sequence
  Description of Artificial Sequence: Synthetic oligonucleotide
  Target: AGXT; (+) strand; PAM type: YTN; PAM sequence: CTT
ttttctttctttcttttttt

SEQ ID NO: 18335 - DNA, 20 bp, Artificial Sequence
  Description of Artificial Sequence: Synthetic oligonucleotide
  Target: AGXT; (+) strand; PAM type: YTN; PAM sequence: TTT
tttctttctttctttttttt

SEQ ID NO: 18336 - DNA, 20 bp, Artificial Sequence
  Description of Artificial Sequence: Synthetic oligonucleotide
  Target: AGXT; (+) strand; PAM type: YTN; PAM sequence: TTT
ttctttctttcttttttttt

SEQ ID NO: 18337 - DNA, 20 bp, Artificial Sequence
  Description of Artificial Sequence: Synthetic oligonucleotide
  Target: AGXT; (+) strand; PAM type: YTN; PAM sequence: TTT
tctttctttctttttttttt

SEQ ID NO: 18338 - DNA, 20 bp, Artificial Sequence
  Description of Artificial Sequence: Synthetic oligonucleotide
  Target: AGXT; (+) strand; PAM type: YTN; PAM sequence: TTT
ctttctttcttttttttttt

SEQ ID NO: 18339 - DNA, 20 bp, Artificial Sequence
  Description of Artificial Sequence: Synthetic oligonucleotide
  Target: AGXT; (+) strand; PAM type: YTN; PAM sequence: TTC
tttctttctttttttttttt

SEQ ID NO: 18340 - DNA, 20 bp, Artificial Sequence
  Description of Artificial Sequence: Synthetic oligonucleotide
  Target: AGXT; (+) strand; PAM type: YTN; PAM sequence: CTT
tctttctttttttttttttt

SEQ ID NO: 18341 - DNA, 20 bp, Artificial Sequence
  Description of Artificial Sequence: Synthetic oligonucleotide
  Target: AGXT; (+) strand; PAM type: YTN; PAM sequence: TTT
ctttcttttttttttttttt

SEQ ID NO: 18342 - DNA, 20 bp, Artificial Sequence
  Description of Artificial Sequence: Synthetic oligonucleotide
  Target: AGXT; (+) strand; PAM type: YTN; PAM sequence: TTC
tttctttttttttttttttt

SEQ ID NO: 18343 - DNA, 20 bp, Artificial Sequence
  Description of Artificial Sequence: Synthetic oligonucleotide
  Target: AGXT; (+) strand; PAM type: YTN; PAM sequence: CTT
tctttttttttttttttttt

SEQ ID NO: 18344 - DNA, 20 bp, Artificial Sequence
  Description of Artificial Sequence: Synthetic oligonucleotide
  Target: AGXT; (+) strand; PAM type: YTN; PAM sequence: TTT
cttttttttttttttttttt

SEQ ID NO: 18345 - DNA, 20 bp, Artificial Sequence
  Description of Artificial Sequence: Synthetic oligonucleotide
  Target: AGXT; (+) strand; PAM type: YTN; PAM sequence: TTC
tttttttttttttttttttt

SEQ ID NO: 18346 - DNA, 20 bp, Artificial Sequence
  Description of Artificial Sequence: Synthetic oligonucleotide
  Target: AGXT; (+) strand; PAM type: YTN; PAM sequence: CTT
tttttttttttttttttttt

SEQ ID NO: 18347 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 18348 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 18349 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttt

SEQ ID NO: 18350 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttttg

SEQ ID NO: 18351 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttttga

SEQ ID NO: 18352 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttttgag

SEQ ID NO: 18353 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttttgaga

SEQ ID NO: 18354 - DNA, 20 bp, Artificial Sequence
  Description of Artificial Sequence: Synthetic oligonucleotide
  Target: AGXT; (+) strand; PAM type: YTN; PAM sequence: TTT
tttttttttttttttgagaa

SEQ ID NO: 18355 - DNA, 20 bp, Artificial Sequence
  Description of Artificial Sequence: Synthetic oligonucleotide
  Target: AGXT; (+) strand; PAM type: YTN; PAM sequence: TTT
ttttttttttttttgagaaa

SEQ ID NO: 18356 - DNA, 20 bp, Artificial Sequence
  Description of Artificial Sequence: Synthetic oligonucleotide
  Target: AGXT; (+) strand; PAM type: YTN; PAM sequence: TTT
tttttttttttttgagaaag

SEQ ID NO: 18357 - DNA, 20 bp, Artificial Sequence
  Description of Artificial Sequence: Synthetic oligonucleotide
  Target: AGXT; (+) strand; PAM type: YTN; PAM sequence: TTT
ttttttttttttgagaaaga

SEQ ID NO: 18358 - DNA, 20 bp, Artificial Sequence
  Description of Artificial Sequence: Synthetic oligonucleotide
  Target: AGXT; (+) strand; PAM type: YTN; PAM sequence: TTT
tttttttttttgagaaagaa

SEQ ID NO: 18359 - DNA, 20 bp, Artificial Sequence
  Description of Artificial Sequence: Synthetic oligonucleotide
  Target: AGXT; (+) strand; PAM type: YTN; PAM sequence: TTT
ttttttttttgagaaagaat

SEQ ID NO: 18360 - DNA, 20 bp, Artificial Sequence
  Description of Artificial Sequence: Synthetic oligonucleotide
  Target: AGXT; (+) strand; PAM type: YTN; PAM sequence: TTT
tttttttttgagaaagaatc

SEQ ID NO: 18361 - DNA, 20 bp, Artificial Sequence
  Description of Artificial Sequence: Synthetic oligonucleotide
  Target: AGXT; (+) strand; PAM type: YTN; PAM sequence: TTT
ttttttttgagaaagaatct

SEQ ID NO: 18362 - DNA, 20 bp, Artificial Sequence
  Description of Artificial Sequence: Synthetic oligonucleotide
  Target: AGXT; (+) strand; PAM type: YTN; PAM sequence: TTT
tttttttgagaaagaatctc

SEQ ID NO: 18363 - DNA, 20 bp, Artificial Sequence
  Description of Artificial Sequence: Synthetic oligonucleotide
  Target: AGXT; (+) strand; PAM type: YTN; PAM sequence: TTT
ttttttgagaaagaatctca

SEQ ID NO: 18364 - DNA, 20 bp, Artificial Sequence
  Description of Artificial Sequence: Synthetic oligonucleotide
  Target: AGXT; (+) strand; PAM type: YTN; PAM sequence: TTT
tttttgagaaagaatctcac

SEQ ID NO: 18365 - DNA, 20 bp, Artificial Sequence
  Description of Artificial Sequence: Synthetic oligonucleotide
  Target: AGXT; (+) strand; PAM type: YTN; PAM sequence: TTT
ttttgagaaagaatctcact

SEQ ID NO: 18366 - DNA, 20 bp, Artificial Sequence
  Description of Artificial Sequence: Synthetic oligonucleotide
  Target: AGXT; (+) strand; PAM type: YTN; PAM sequence: TTT
tttgagaaagaatctcactc

SEQ ID NO: 18367 - DNA, 20 bp, Artificial Sequence
  Description of Artificial Sequence: Synthetic oligonucleotide
  Target: AGXT; (+) strand; PAM type: YTN; PAM sequence: TTT
ttgagaaagaatctcactcc

SEQ ID NO: 18368 - DNA, 20 bp, Artificial Sequence
  Description of Artificial Sequence: Synthetic oligonucleotide
  Target: AGXT; (+) strand; PAM type: YTN; PAM sequence: TTT
tgagaaagaatctcactccg

SEQ ID NO: 18369 - DNA, 20 bp, Artificial Sequence
  Description of Artificial Sequence: Synthetic oligonucleotide
  Target: AGXT; (+) strand; PAM type: YTN; PAM sequence: TTT
gagaaagaatctcactccgt

SEQ ID NO: 18370 - DNA, 20 bp, Artificial Sequence
  Description of Artificial Sequence: Synthetic oligonucleotide
  Target: AGXT; (+) strand; PAM type: YTN; PAM sequence: TTG
agaaagaatctcactccgtc

SEQ ID NO: 18371 - DNA, 20 bp, Artificial Sequence
  Description of Artificial Sequence: Synthetic oligonucleotide
  Target: AGXT; (+) strand; PAM type: YTN; PAM sequence: CTC
actccgtccaggctggagag

SEQ ID NO: 18372 - DNA, 20 bp, Artificial Sequence
  Description of Artificial Sequence: Synthetic oligonucleotide
  Target: AGXT; (+) strand; PAM type: YTN; PAM sequence: CTC
cgtccaggctggagagcagt

SEQ ID NO: 18373 - DNA, 20 bp, Artificial Sequence
  Description of Artificial Sequence: Synthetic oligonucleotide
  Target: AGXT; (+) strand; PAM type: YTN; PAM sequence: CTG
gagagcagtggtgtgatctc

SEQ ID NO: 18374 - DNA, 20 bp, Artificial Sequence
  Description of Artificial Sequence: Synthetic oligonucleotide
  Target: AGXT; (+) strand; PAM type: YTN; PAM sequence: CTC
agctcactgcaacctccacc

SEQ ID NO: 18375 - DNA, 20 bp, Artificial Sequence
  Description of Artificial Sequence: Synthetic oligonucleotide
  Target: AGXT; (+) strand; PAM type: YTN; PAM sequence: CTC
actgcaacctccacctcccg

SEQ ID NO: 18376 - DNA, 20 bp, Artificial Sequence
  Description of Artificial Sequence: Synthetic oligonucleotide
  Target: AGXT; (+) strand; PAM type: YTN; PAM sequence: CTG
caacctccacctcccgggtt

SEQ ID NO: 18377 - DNA, 20 bp, Artificial Sequence
  Description of Artificial Sequence: Synthetic oligonucleotide
  Target: AGXT; (+) strand; PAM type: YTN; PAM sequence: CTC
cacctcccgggttcaagaga

SEQ ID NO: 18378 - DNA, 20 bp, Artificial Sequence
  Description of Artificial Sequence: Synthetic oligonucleotide
  Target: AGXT; (+) strand; PAM type: YTN; PAM sequence: CTC
ccgggttcaagagattctcc

SEQ ID NO: 18379 - DNA, 20 bp, Artificial Sequence
  Description of Artificial Sequence: Synthetic oligonucleotide
  Target: AGXT; (+) strand; PAM type: YTN; PAM sequence: TTC
aagagattctcctgcctcag

SEQ ID NO: 18380 - DNA, 20 bp, Artificial Sequence
  Description of Artificial Sequence: Synthetic oligonucleotide
  Target: AGXT; (+) strand; PAM type: YTN; PAM sequence: TTC
tcctgcctcagcctcccaag

SEQ ID NO: 18381 - DNA, 20 bp, Artificial Sequence
  Description of Artificial Sequence: Synthetic oligonucleotide
  Target: AGXT; (+) strand; PAM type: YTN; PAM sequence: CTC
ctgcctcagcctcccaagta

SEQ ID NO: 18382 - DNA, 20 bp, Artificial Sequence
  Description of Artificial Sequence: Synthetic oligonucleotide
  Target: AGXT; (+) strand; PAM type: YTN; PAM sequence: CTG
cctcagcctcccaagtagct

SEQ ID NO: 18383 - DNA, 20 bp, Artificial Sequence
  Description of Artificial Sequence: Synthetic oligonucleotide
  Target: AGXT; (+) strand; PAM type: YTN; PAM sequence: CTC
agcctcccaagtagctggga

SEQ ID NO: 18384 - DNA, 20 bp, Artificial Sequence
  Description of Artificial Sequence: Synthetic oligonucleotide
  Target: AGXT; (+) strand; PAM type: YTN; PAM sequence: CTC
ccaagtagctgggattacag

SEQ ID NO: 18385 - DNA, 20 bp, Artificial Sequence
  Description of Artificial Sequence: Synthetic oligonucleotide
  Target: AGXT; (+) strand; PAM type: YTN; PAM sequence: CTG
ggattacaggcatgcaccac

SEQ ID NO: 18386 - DNA, 20 bp, Artificial Sequence
  Description of Artificial Sequence: Synthetic oligonucleotide
  Target: AGXT; (+) strand; PAM type: YTN; PAM sequence: TTA
caggcatgcaccaccacacc

SEQ ID NO: 18387 - DNA, 20 bp, Artificial Sequence
  Description of Artificial Sequence: Synthetic oligonucleotide
  Target: AGXT; (+) strand; PAM type: YTN; PAM sequence: CTA
atttttgtgtttttttgtag

SEQ ID NO: 18388 - DNA, 20 bp, Artificial Sequence
  Description of Artificial Sequence: Synthetic oligonucleotide
  Target: AGXT; (+) strand; PAM type: YTN; PAM sequence: TTT
ttgtgtttttttgtagagac

SEQ ID NO: 18389 - DNA, 20 bp, Artificial Sequence
  Description of Artificial Sequence: Synthetic oligonucleotide
  Target: AGXT; (+) strand; PAM type: YTN; PAM sequence: TTT
tgtgtttttttgtagagacg

SEQ ID NO: 18390 - DNA, 20 bp, Artificial Sequence
  Description of Artificial Sequence: Synthetic oligonucleotide
  Target: AGXT; (+) strand; PAM type: YTN; PAM sequence: TTT
gtgtttttttgtagagacgg

SEQ ID NO: 18391 - DNA, 20 bp, Artificial Sequence
  Description of Artificial Sequence: Synthetic oligonucleotide
  Target: AGXT; (+) strand; PAM type: YTN; PAM sequence: TTG
tgtttttttgtagagacggg

SEQ ID NO: 18392 - DNA, 20 bp, Artificial Sequence
  Description of Artificial Sequence: Synthetic oligonucleotide
  Target: AGXT; (+) strand; PAM type: YTN; PAM sequence: TTT
ttttgtagagacggggtttt

SEQ ID NO: 18393 - DNA, 20 bp, Artificial Sequence
  Description of Artificial Sequence: Synthetic oligonucleotide
  Target: AGXT; (+) strand; PAM type: YTN; PAM sequence: TTT
tttgtagagacggggttttg

SEQ ID NO: 18394 - DNA, 20 bp, Artificial Sequence
  Description of Artificial Sequence: Synthetic oligonucleotide
  Target: AGXT; (+) strand; PAM type: YTN; PAM sequence: TTT
ttgtagagacggggttttgc

SEQ ID NO: 18395 - DNA, 20 bp, Artificial Sequence
  Description of Artificial Sequence: Synthetic oligonucleotide
  Target: AGXT; (+) strand; PAM type: YTN; PAM sequence: TTT
tgtagagacggggttttgcc

SEQ ID NO: 18396 - DNA, 20 bp, Artificial Sequence
  Description of Artificial Sequence: Synthetic oligonucleotide
  Target: AGXT; (+) strand; PAM type: YTN; PAM sequence: TTT
gtagagacggggttttgcca

SEQ ID NO: 18397 - DNA, 20 bp, Artificial Sequence
  Description of Artificial Sequence: Synthetic oligonucleotide
  Target: AGXT; (+) strand; PAM type: YTN; PAM sequence: TTG
tagagacggggttttgccat

SEQ ID NO: 18398 - DNA, 20 bp, Artificial Sequence
  Description of Artificial Sequence: Synthetic oligonucleotide
  Target: AGXT; (+) strand; PAM type: YTN; PAM sequence: TTT
tgccatgttggccaggctgg

SEQ ID NO: 18399 - DNA, 20 bp, Artificial Sequence
  Description of Artificial Sequence: Synthetic oligonucleotide
  Target: AGXT; (+) strand; PAM type: YTN; PAM sequence: TTT
gccatgttggccaggctggt

SEQ ID NO: 18400 - DNA, 20 bp, Artificial Sequence
  Description of Artificial Sequence: Synthetic oligonucleotide
  Target: AGXT; (+) strand; PAM type: YTN; PAM sequence: TTG
ccatgttggccaggctggtc

SEQ ID NO: 18401 - DNA, 20 bp, Artificial Sequence
  Description of Artificial Sequence: Synthetic oligonucleotide
  Target: AGXT; (+) strand; PAM type: YTN; PAM sequence: TTG
gccaggctggtctcaaattc

SEQ ID NO: 18402 - DNA, 20 bp, Artificial Sequence
  Description of Artificial Sequence: Synthetic oligonucleotide
  Target: AGXT; (+) strand; PAM type: YTN; PAM sequence: CTG
gtctcaaattcctgacctca

SEQ ID NO: 18403 - DNA, 20 bp, Artificial Sequence
  Description of Artificial Sequence: Synthetic oligonucleotide
  Target: AGXT; (+) strand; PAM type: YTN; PAM sequence: CTC
aaattcctgacctcaagtga

SEQ ID NO: 18404 - DNA, 20 bp, Artificial Sequence
  Description of Artificial Sequence: Synthetic oligonucleotide
  Target: AGXT; (+) strand; PAM type: YTN; PAM sequence: TTC
ctgacctcaagtgatccacc

SEQ ID NO: 18405 - DNA, 20 bp, Artificial Sequence
  Description of Artificial Sequence: Synthetic oligonucleotide
  Target: AGXT; (+) strand; PAM type: YTN; PAM sequence: CTG
acctcaagtgatccacccac

SEQ ID NO: 18406 - DNA, 20 bp, Artificial Sequence
  Description of Artificial Sequence: Synthetic oligonucleotide
  Target: AGXT; (+) strand; PAM type: YTN; PAM sequence: CTC
aagtgatccacccacctcag

SEQ ID NO: 18407 - DNA, 20 bp, Artificial Sequence
  Description of Artificial Sequence: Synthetic oligonucleotide
  Target: AGXT; (+) strand; PAM type: YTN; PAM sequence: CTC
agcctcccaaagtgctggga

SEQ ID NO: 18408 - DNA, 20 bp, Artificial Sequence
  Description of Artificial Sequence: Synthetic oligonucleotide
  Target: AGXT; (+) strand; PAM type: YTN; PAM sequence: CTC
ccaaagtgctgggattacag

SEQ ID NO: 18409 - DNA, 20 bp, Artificial Sequence
  Description of Artificial Sequence: Synthetic oligonucleotide
  Target: AGXT; (+) strand; PAM type: YTN; PAM sequence: CTG
ggattacaggcatgagccac

SEQ ID NO: 18410 - DNA, 20 bp, Artificial Sequence
  Description of Artificial Sequence: Synthetic oligonucleotide
  Target: AGXT; (+) strand; PAM type: YTN; PAM sequence: TTA
caggcatgagccaccacacc

SEQ ID NO: 18411 - DNA, 20 bp, Artificial Sequence
  Description of Artificial Sequence: Synthetic oligonucleotide
  Target: AGXT; (+) strand; PAM type: YTN; PAM sequence: CTT
acctattcattttcttaatt

SEQ ID NO: 18412 - DNA, 20 bp, Artificial Sequence
  Description of Artificial Sequence: Synthetic oligonucleotide
  Target: AGXT; (+) strand; PAM type: YTN; PAM sequence: TTA
cctattcattttcttaattg

SEQ ID NO: 18413 - DNA, 20 bp, Artificial Sequence
  Description of Artificial Sequence: Synthetic oligonucleotide
  Target: AGXT; (+) strand; PAM type: YTN; PAM sequence: CTA
ttcattttcttaattgtgtc

SEQ ID NO: 18414 - DNA, 20 bp, Artificial Sequence
  Description of Artificial Sequence: Synthetic oligonucleotide
  Target: AGXT; (+) strand; PAM type: YTN; PAM sequence: TTC
attttcttaattgtgtcttt

SEQ ID NO: 18415 - DNA, 20 bp, Artificial Sequence
  Description of Artificial Sequence: Synthetic oligonucleotide
  Target: AGXT; (+) strand; PAM type: YTN; PAM sequence: TTT
tcttaattgtgtctttcaaa

SEQ ID NO: 18416 - DNA, 20 bp, Artificial Sequence
  Description of Artificial Sequence: Synthetic oligonucleotide
  Target: AGXT; (+) strand; PAM type: YTN; PAM sequence: TTT
cttaattgtgtctttcaaag

SEQ ID NO: 18417 - DNA, 20 bp, Artificial Sequence
  Description of Artificial Sequence: Synthetic oligonucleotide
  Target: AGXT; (+) strand; PAM type: YTN; PAM sequence: TTC
ttaattgtgtctttcaaaga

SEQ ID NO: 18418 - DNA, 20 bp, Artificial Sequence
  Description of Artificial Sequence: Synthetic oligonucleotide
  Target: AGXT; (+) strand; PAM type: YTN; PAM sequence: CTT
aattgtgtctttcaaagagc

SEQ ID NO: 18419 - DNA, 20 bp, Artificial Sequence
  Description of Artificial Sequence: Synthetic oligonucleotide
  Target: AGXT; (+) strand; PAM type: YTN; PAM sequence: TTA
attgtgtctttcaaagagca

SEQ ID NO: 18420 - DNA, 20 bp, Artificial Sequence
  Description of Artificial Sequence: Synthetic oligonucleotide
  Target: AGXT; (+) strand; PAM type: YTN; PAM sequence: TTG
tgtctttcaaagagcaggta

SEQ ID NO: 18421 - DNA, 20 bp, Artificial Sequence
  Description of Artificial Sequence: Synthetic oligonucleotide
  Target: AGXT; (+) strand; PAM type: YTN; PAM sequence: CTT
tcaaagagcaggtattttca

SEQ ID NO: 18422 - DNA, 20 bp, Artificial Sequence
  Description of Artificial Sequence: Synthetic oligonucleotide
  Target: AGXT; (+) strand; PAM type: YTN; PAM sequence: TTT
caaagagcaggtattttcaa

SEQ ID NO: 18423 - DNA, 20 bp, Artificial Sequence
  Description of Artificial Sequence: Synthetic oligonucleotide
  Target: AGXT; (+) strand; PAM type: YTN; PAM sequence: TTC
aaagagcaggtattttcaat

SEQ ID NO: 18424 - DNA, 20 bp, Artificial Sequence
  Description of Artificial Sequence: Synthetic oligonucleotide
  Target: AGXT; (+) strand; PAM type: YTN; PAM sequence: TTT
tcaattttggtgaagtcgta

SEQ ID NO: 18425 - DNA, 20 bp, Artificial Sequence
  Description of Artificial Sequence: Synthetic oligonucleotide
  Target: AGXT; (+) strand; PAM type: YTN; PAM sequence: TTT
caattttggtgaagtcgtat

SEQ ID NO: 18426 - DNA, 20 bp, Artificial Sequence
  Description of Artificial Sequence: Synthetic oligonucleotide
  Target: AGXT; (+) strand; PAM type: YTN; PAM sequence: TTC
aattttggtgaagtcgtatt

SEQ ID NO: 18427 - DNA, 20 bp, Artificial Sequence
  Description of Artificial Sequence: Synthetic oligonucleotide
  Target: AGXT; (+) strand; PAM type: YTN; PAM sequence: TTT
tggtgaagtcgtatttatga

SEQ ID NO: 18428 - DNA, 20 bp, Artificial Sequence
  Description of Artificial Sequence: Synthetic oligonucleotide
  Target: AGXT; (+) strand; PAM type: YTN; PAM sequence: TTT
ggtgaagtcgtatttatgaa

SEQ ID NO: 18429 - DNA, 20 bp, Artificial Sequence
  Description of Artificial Sequence: Synthetic oligonucleotide
  Target: AGXT; (+) strand; PAM type: YTN; PAM sequence: TTG
gtgaagtcgtatttatgaat

SEQ ID NO: 18430 - DNA, 20 bp, Artificial Sequence
  Description of Artificial Sequence: Synthetic oligonucleotide
  Target: AGXT; (+) strand; PAM type: YTN; PAM sequence: TTT
atgaatgagtttttttctat

SEQ ID NO: 18431 - DNA, 20 bp, Artificial Sequence
  Description of Artificial Sequence: Synthetic oligonucleotide
  Target: AGXT; (+) strand; PAM type: YTN; PAM sequence: TTA
tgaatgagtttttttctatg

SEQ ID NO: 18432 - DNA, 20 bp, Artificial Sequence
  Description of Artificial Sequence: Synthetic oligonucleotide
  Target: AGXT; (+) strand; PAM type: YTN; PAM sequence: TTT
ttttctatggtctgggctgt

SEQ ID NO: 18433 - DNA, 20 bp, Artificial Sequence
  Description of Artificial Sequence: Synthetic oligonucleotide
  Target: AGXT; (+) strand; PAM type: YTN; PAM sequence: TTT
tttctatggtctgggctgtt

SEQ ID NO: 18434 - DNA, 20 bp, Artificial Sequence
  Description of Artificial Sequence: Synthetic oligonucleotide
  Target: AGXT; (+) strand; PAM type: YTN; PAM sequence: TTT
ttctatggtctgggctgttt

SEQ ID NO: 18435 - DNA, 20 bp, Artificial Sequence
  Description of Artificial Sequence: Synthetic oligonucleotide
  Target: AGXT; (+) strand; PAM type: YTN; PAM sequence: TTT
tctatggtctgggctgtttg

SEQ ID NO: 18436 - DNA, 20 bp, Artificial Sequence
  Description of Artificial Sequence: Synthetic oligonucleotide
  Target: AGXT; (+) strand; PAM type: YTN; PAM sequence: TTT
ctatggtctgggctgtttgt

SEQ ID NO: 18437 - DNA, 20 bp, Artificial Sequence
  Description of Artificial Sequence: Synthetic oligonucleotide
  Target: AGXT; (+) strand; PAM type: YTN; PAM sequence: TTC
tatggtctgggctgtttgta

SEQ ID NO: 18438 - DNA, 20 bp, Artificial Sequence
  Description of Artificial Sequence: Synthetic oligonucleotide
  Target: AGXT; (+) strand; PAM type: YTN; PAM sequence: CTA
tggtctgggctgtttgtatc

SEQ ID NO: 18439 - DNA, 20 bp, Artificial Sequence
  Description of Artificial Sequence: Synthetic oligonucleotide
  Target: AGXT; (+) strand; PAM type: YTN; PAM sequence: CTG
ggctgtttgtatcttgtcta

SEQ ID NO: 18440 - DNA, 20 bp, Artificial Sequence
  Description of Artificial Sequence: Synthetic oligonucleotide
  Target: AGXT; (+) strand; PAM type: YTN; PAM sequence: CTG
tttgtatcttgtctaagaaa

SEQ ID NO: 18441 - DNA, 20 bp, Artificial Sequence
  Description of Artificial Sequence: Synthetic oligonucleotide
  Target: AGXT; (+) strand; PAM type: YTN; PAM sequence: TTT
gtatcttgtctaagaaacct

SEQ ID NO: 18442 - DNA, 20 bp, Artificial Sequence
  Description of Artificial Sequence: Synthetic oligonucleotide
  Target: AGXT; (+) strand; PAM type: YTN; PAM sequence: TTG
tatcttgtctaagaaacctt

SEQ ID NO: 18443 - DNA, 20 bp, Artificial Sequence
  Description of Artificial Sequence: Synthetic oligonucleotide
  Target: AGXT; (+) strand; PAM type: YTN; PAM sequence: CTT
gtctaagaaacctttgccta

SEQ ID NO: 18444 - DNA, 20 bp, Artificial Sequence
  Description of Artificial Sequence: Synthetic oligonucleotide
  Target: AGXT; (+) strand; PAM type: YTN; PAM sequence: TTG
tctaagaaacctttgcctac

SEQ ID NO: 18445 - DNA, 20 bp, Artificial Sequence
  Description of Artificial Sequence: Synthetic oligonucleotide
  Target: AGXT; (+) strand; PAM type: YTN; PAM sequence: CTA
agaaacctttgcctactttg

SEQ ID NO: 18446 - DNA, 20 bp, Artificial Sequence
  Description of Artificial Sequence: Synthetic oligonucleotide
  Target: AGXT; (+) strand; PAM type: YTN; PAM sequence: CTT
tgcctactttgaggtctgga

SEQ ID NO: 18447 - DNA, 20 bp, Artificial Sequence
  Description of Artificial Sequence: Synthetic oligonucleotide
  Target: AGXT; (+) strand; PAM type: YTN; PAM sequence: TTT
gcctactttgaggtctggac

SEQ ID NO: 18448 - DNA, 20 bp, Artificial Sequence
  Description of Artificial Sequence: Synthetic oligonucleotide
  Target: AGXT; (+) strand; PAM type: YTN; PAM sequence: TTG
cctactttgaggtctggacg

SEQ ID NO: 18449 - DNA, 20 bp, Artificial Sequence
  Description of Artificial Sequence: Synthetic oligonucleotide
  Target: AGXT; (+) strand; PAM type: YTN; PAM sequence: CTA
ctttgaggtctggacggtat

SEQ ID NO: 18450 - DNA, 20 bp, Artificial Sequence
  Description of Artificial Sequence: Synthetic oligonucleotide
  Target: AGXT; (+) strand; PAM type: YTN; PAM sequence: CTT
tgaggtctggacggtatctt

SEQ ID NO: 18451 - DNA, 20 bp, Artificial Sequence
  Description of Artificial Sequence: Synthetic oligonucleotide
  Target: AGXT; (+) strand; PAM type: YTN; PAM sequence: TTT
gaggtctggacggtatcttc

SEQ ID NO: 18452 - DNA, 20 bp, Artificial Sequence
  Description of Artificial Sequence: Synthetic oligonucleotide
  Target: AGXT; (+) strand; PAM type: YTN; PAM sequence: TTG
aggtctggacggtatcttcc

SEQ ID NO: 18453 - DNA, 20 bp, Artificial Sequence
  Description of Artificial Sequence: Synthetic oligonucleotide
  Target: AGXT; (+) strand; PAM type: YTN; PAM sequence: CTG
gacggtatcttcctgtgttt

SEQ ID NO: 18454 - DNA, 20 bp, Artificial Sequence
  Description of Artificial Sequence: Synthetic oligonucleotide
  Target: AGXT; (+) strand; PAM type: YTN; PAM sequence: CTT
cctgtgttttcttctagaaa

SEQ ID NO: 18455 - DNA, 20 bp, Artificial Sequence
  Description of Artificial Sequence: Synthetic oligonucleotide
  Target: AGXT; (+) strand; PAM type: YTN; PAM sequence: TTC
ctgtgttttcttctagaaac

SEQ ID NO: 18456 - DNA, 20 bp, Artificial Sequence
  Description of Artificial Sequence: Synthetic oligonucleotide
  Target: AGXT; (+) strand; PAM type: YTN; PAM sequence: CTG
tgttttcttctagaaacttt

SEQ ID NO: 18457 - DNA, 20 bp, Artificial Sequence
  Description of Artificial Sequence: Synthetic oligonucleotide
  Target: AGXT; (+) strand; PAM type: YTN; PAM sequence: TTT
tcttctagaaactttacagt

SEQ ID NO: 18458 - DNA, 20 bp, Artificial Sequence
  Description of Artificial Sequence: Synthetic oligonucleotide
  Target: AGXT; (+) strand; PAM type: YTN; PAM sequence: TTT
cttctagaaactttacagtg

SEQ ID NO: 18459 - DNA, 20 bp, Artificial Sequence
  Description of Artificial Sequence: Synthetic oligonucleotide
  Target: AGXT; (+) strand; PAM type: YTN; PAM sequence: TTC
ttctagaaactttacagtgt

SEQ ID NO: 18460 - DNA, 20 bp, Artificial Sequence
  Description of Artificial Sequence: Synthetic oligonucleotide
  Target: AGXT; (+) strand; PAM type: YTN; PAM sequence: CTT
ctagaaactttacagtgtca

SEQ ID NO: 18461 - DNA, 20 bp, Artificial Sequence
  Description of Artificial Sequence: Synthetic oligonucleotide
  Target: AGXT; (+) strand; PAM type: YTN; PAM sequence: TTC
tagaaactttacagtgtcag

SEQ ID NO: 18462 - DNA, 20 bp, Artificial Sequence
  Description of Artificial Sequence: Synthetic oligonucleotide
  Target: AGXT; (+) strand; PAM type: YTN; PAM sequence: CTA
gaaactttacagtgtcagct

SEQ ID NO: 18463 - DNA, 20 bp, Artificial Sequence
  Description of Artificial Sequence: Synthetic oligonucleotide
  Target: AGXT; (+) strand; PAM type: YTN; PAM sequence: CTT
tacagtgtcagcttttgtat

SEQ ID NO: 18464 - DNA, 20 bp, Artificial Sequence
  Description of Artificial Sequence: Synthetic oligonucleotide
  Target: AGXT; (+) strand; PAM type: YTN; PAM sequence: TTT
acagtgtcagcttttgtatt

SEQ ID NO: 18465 - DNA, 20 bp, Artificial Sequence
  Description of Artificial Sequence: Synthetic oligonucleotide
  Target: AGXT; (+) strand; PAM type: YTN; PAM sequence: TTA
cagtgtcagcttttgtattt

SEQ ID NO: 18466 - DNA, 20 bp, Artificial Sequence
  Description of Artificial Sequence: Synthetic oligonucleotide
  Target: AGXT; (+) strand; PAM type: YTN; PAM sequence: CTT
ttgtatttaggtctatgata

SEQ ID NO: 18467 - DNA, 20 bp, Artificial Sequence
  Description of Artificial Sequence: Synthetic oligonucleotide
  Target: AGXT; (+) strand; PAM type: YTN; PAM sequence: TTT
tgtatttaggtctatgatac

SEQ ID NO: 18468 - DNA, 20 bp, Artificial Sequence
  Description of Artificial Sequence: Synthetic oligonucleotide
  Target: AGXT; (+) strand; PAM type: YTN; PAM sequence: TTT
gtatttaggtctatgataca

SEQ ID NO: 18469 - DNA, 20 bp, Artificial Sequence
  Description of Artificial Sequence: Synthetic oligonucleotide
  Target: AGXT; (+) strand; PAM type: YTN; PAM sequence: TTG
tatttaggtctatgatacac

SEQ ID NO: 18470 - DNA, 20 bp, Artificial Sequence
  Description of Artificial Sequence: Synthetic oligonucleotide
  Target: AGXT; (+) strand; PAM type: YTN; PAM sequence: TTT
aggtctatgatacacctcat

SEQ ID NO: 18471 - DNA, 20 bp, Artificial Sequence
  Description of Artificial Sequence: Synthetic oligonucleotide
  Target: AGXT; (+) strand; PAM type: YTN; PAM sequence: TTA
ggtctatgatacacctcata

SEQ ID NO: 18472 - DNA, 20 bp, Artificial Sequence
  Description of Artificial Sequence: Synthetic oligonucleotide
  Target: AGXT; (+) strand; PAM type: YTN; PAM sequence: CTA
tgatacacctcatattaatt

SEQ ID NO: 18473 - DNA, 20 bp, Artificial Sequence
  Description of Artificial Sequence: Synthetic oligonucleotide
  Target: AGXT; (+) strand; PAM type: YTN; PAM sequence: CTC
atattaattttgtgcacagt

SEQ ID NO: 18474 - DNA, 20 bp, Artificial Sequence
  Description of Artificial Sequence: Synthetic oligonucleotide
  Target: AGXT; (+) strand; PAM type: YTN; PAM sequence: TTA
attttgtgcacagtgtagaa

SEQ ID NO: 18475 - DNA, 20 bp, Artificial Sequence
  Description of Artificial Sequence: Synthetic oligonucleotide
  Target: AGXT; (+) strand; PAM type: YTN; PAM sequence: TTT
tgtgcacagtgtagaaaggg

SEQ ID NO: 18476 - DNA, 20 bp, Artificial Sequence
  Description of Artificial Sequence: Synthetic oligonucleotide
  Target: AGXT; (+) strand; PAM type: YTN; PAM sequence: TTT
gtgcacagtgtagaaagggg

SEQ ID NO: 18477 - DNA, 20 bp, Artificial Sequence
  Description of Artificial Sequence: Synthetic oligonucleotide
  Target: AGXT; (+) strand; PAM type: YTN; PAM sequence: TTG
tgcacagtgtagaaaggggg

SEQ ID NO: 18478 - DNA, 20 bp, Artificial Sequence
  Description of Artificial Sequence: Synthetic oligonucleotide
  Target: AGXT; (+) strand; PAM type: YTN; PAM sequence: TTC
atttttatccatactgatat

SEQ ID NO: 18479 - DNA, 20 bp, Artificial Sequence
  Description of Artificial Sequence: Synthetic oligonucleotide
  Target: AGXT; (+) strand; PAM type: YTN; PAM sequence: TTT
ttatccatactgatatccca

SEQ ID NO: 18480 - DNA, 20 bp, Artificial Sequence
  Description of Artificial Sequence: Synthetic oligonucleotide
  Target: AGXT; (+) strand; PAM type: YTN; PAM sequence: TTT
tatccatactgatatcccag

SEQ ID NO: 18481 - DNA, 20 bp, Artificial Sequence
  Description of Artificial Sequence: Synthetic oligonucleotide
  Target: AGXT; (+) strand; PAM type: YTN; PAM sequence: TTT
atccatactgatatcccagt

SEQ ID NO: 18482 - DNA, 20 bp, Artificial Sequence
  Description of Artificial Sequence: Synthetic oligonucleotide
  Target: AGXT; (+) strand; PAM type: YTN; PAM sequence: TTA
tccatactgatatcccagtt

SEQ ID NO: 18483 - DNA, 20 bp, Artificial Sequence
  Description of Artificial Sequence: Synthetic oligonucleotide
  Target: AGXT; (+) strand; PAM type: YTN; PAM sequence: CTG
atatcccagttccagtaacg

SEQ ID NO: 18484 - DNA, 20 bp, Artificial Sequence
  Description of Artificial Sequence: Synthetic oligonucleotide
  Target: AGXT; (+) strand; PAM type: YTN; PAM sequence: TTC
cagtaacgtttgttaaacag

SEQ ID NO: 18485 - DNA, 20 bp, Artificial Sequence
  Description of Artificial Sequence: Synthetic oligonucleotide
  Target: AGXT; (+) strand; PAM type: YTN; PAM sequence: TTT
gttaaacagactttcctttc

SEQ ID NO: 18486 - DNA, 20 bp, Artificial Sequence
  Description of Artificial Sequence: Synthetic oligonucleotide
  Target: AGXT; (+) strand; PAM type: YTN; PAM sequence: TTG
ttaaacagactttcctttcc

SEQ ID NO: 18487 - DNA, 20 bp, Artificial Sequence
  Description of Artificial Sequence: Synthetic oligonucleotide
  Target: AGXT; (+) strand; PAM type: YTN; PAM sequence: TTA
aacagactttcctttcccca

SEQ ID NO: 18488 - DNA, 20 bp, Artificial Sequence
  Description of Artificial Sequence: Synthetic oligonucleotide
  Target: AGXT; (+) strand; PAM type: YTN; PAM sequence: CTT
tcctttccccattgaactga

SEQ ID NO: 18489 - DNA, 20 bp, Artificial Sequence
  Description of Artificial Sequence: Synthetic oligonucleotide
  Target: AGXT; (+) strand; PAM type: YTN; PAM sequence: TTT
cctttccccattgaactgac

SEQ ID NO: 18490 - DNA, 20 bp, Artificial Sequence
  Description of Artificial Sequence: Synthetic oligonucleotide
  Target: AGXT; (+) strand; PAM type: YTN; PAM sequence: TTC
ctttccccattgaactgact

SEQ ID NO: 18491 - DNA, 20 bp, Artificial Sequence
  Description of Artificial Sequence: Synthetic oligonucleotide
  Target: AGXT; (+) strand; PAM type: YTN; PAM sequence: CTT
tccccattgaactgacttga

SEQ ID NO: 18492 - DNA, 20 bp, Artificial Sequence
  Description of Artificial Sequence: Synthetic oligonucleotide
  Target: AGXT; (+) strand; PAM type: YTN; PAM sequence: TTT
ccccattgaactgacttgac

SEQ ID NO: 18493 - DNA, 20 bp, Artificial Sequence
  Description of Artificial Sequence: Synthetic oligonucleotide
  Target: AGXT; (+) strand; PAM type: YTN; PAM sequence: TTC
cccattgaactgacttgaca

SEQ ID NO: 18494 - DNA, 20 bp, Artificial Sequence
  Description of Artificial Sequence: Synthetic oligonucleotide
  Target: AGXT; (+) strand; PAM type: YTN; PAM sequence: TTG
aactgacttgacaactttgt

SEQ ID NO: 18495 - DNA, 20 bp, Artificial Sequence
  Description of Artificial Sequence: Synthetic oligonucleotide
  Target: AGXT; (+) strand; PAM type: YTN; PAM sequence: CTG
acttgacaactttgttaaaa

SEQ ID NO: 18496 - DNA, 20 bp, Artificial Sequence
  Description of Artificial Sequence: Synthetic oligonucleotide
  Target: AGXT; (+) strand; PAM type: YTN; PAM sequence: CTT
gacaactttgttaaaaatca

SEQ ID NO: 18497 - DNA, 20 bp, Artificial Sequence
  Description of Artificial Sequence: Synthetic oligonucleotide
  Target: AGXT; (+) strand; PAM type: YTN; PAM sequence: TTG
acaactttgttaaaaatcag

SEQ ID NO: 18498 - DNA, 20 bp, Artificial Sequence
  Description of Artificial Sequence: Synthetic oligonucleotide
  Target: AGXT; (+) strand; PAM type: YTN; PAM sequence: CTT
tgttaaaaatcagttgacta

SEQ ID NO: 18499 - DNA, 20 bp, Artificial Sequence
  Description of Artificial Sequence: Synthetic oligonucleotide
  Target: AGXT; (+) strand; PAM type: YTN; PAM sequence: TTT
gttaaaaatcagttgactac

SEQ ID NO: 18500 - DNA, 20 bp, Artificial Sequence
  Description of Artificial Sequence: Synthetic oligonucleotide
  Target: AGXT; (+) strand; PAM type: YTN; PAM sequence: TTG
ttaaaaatcagttgactaca

SEQ ID NO: 18501 - DNA, 20 bp, Artificial Sequence
  Description of Artificial Sequence: Synthetic oligonucleotide
  Target: AGXT; (+) strand; PAM type: YTN; PAM sequence: TTA
aaaatcagttgactacacat

SEQ ID NO: 18502 - DNA, 20 bp, Artificial Sequence
  Description of Artificial Sequence: Synthetic oligonucleotide
  Target: AGXT; (+) strand; PAM type: YTN; PAM sequence: TTG
actacacattcataggtcta

SEQ ID NO: 18503 - DNA, 20 bp, Artificial Sequence
  Description of Artificial Sequence: Synthetic oligonucleotide
  Target: AGXT; (+) strand; PAM type: YTN; PAM sequence: CTA
cacattcataggtctattta

SEQ ID NO: 18504 - DNA, 20 bp, Artificial Sequence
  Description of Artificial Sequence: Synthetic oligonucleotide
  Target: AGXT; (+) strand; PAM type: YTN; PAM sequence: TTC
ataggtctatttacagcctc

SEQ ID NO: 18505 - DNA, 20 bp, Artificial Sequence
  Description of Artificial Sequence: Synthetic oligonucleotide
  Target: AGXT; (+) strand; PAM type: YTN; PAM sequence: CTA
tttacagcctctcttctgtt

SEQ ID NO: 18506 - DNA, 20 bp, Artificial Sequence
  Description of Artificial Sequence: Synthetic oligonucleotide
  Target: AGXT; (+) strand; PAM type: YTN; PAM sequence: TTT
acagcctctcttctgtttca

SEQ ID NO: 18507 - DNA, 20 bp, Artificial Sequence
  Description of Artificial Sequence: Synthetic oligonucleotide
  Target: AGXT; (+) strand; PAM type: YTN; PAM sequence: TTA
cagcctctcttctgtttcat

SEQ ID NO: 18508 - DNA, 20 bp, Artificial Sequence
  Description of Artificial Sequence: Synthetic oligonucleotide
  Target: AGXT; (+) strand; PAM type: YTN; PAM sequence: CTC
tcttctgtttcattgcatcc

SEQ ID NO: 18509 - DNA, 20 bp, Artificial Sequence
  Description of Artificial Sequence: Synthetic oligonucleotide
  Target: AGXT; (+) strand; PAM type: YTN; PAM sequence: CTC
ttctgtttcattgcatcctc

SEQ ID NO: 18510 - DNA, 20 bp, Artificial Sequence
  Description of Artificial Sequence: Synthetic oligonucleotide
  Target: AGXT; (+) strand; PAM type: YTN; PAM sequence: CTT
ctgtttcattgcatcctcgt

SEQ ID NO: 18511 - DNA, 20 bp, Artificial Sequence
  Description of Artificial Sequence: Synthetic oligonucleotide
  Target: AGXT; (+) strand; PAM type: YTN; PAM sequence: TTC
tgtttcattgcatcctcgtg

SEQ ID NO: 18512 - DNA, 20 bp, Artificial Sequence
  Description of Artificial Sequence: Synthetic oligonucleotide
  Target: AGXT; (+) strand; PAM type: YTN; PAM sequence: CTG
tttcattgcatcctcgtgtc

SEQ ID NO: 18513 - DNA, 20 bp, Artificial Sequence
  Description of Artificial Sequence: Synthetic oligonucleotide
  Target: AGXT; (+) strand; PAM type: YTN; PAM sequence: TTT
cattgcatcctcgtgtcaat

SEQ ID NO: 18514 - DNA, 20 bp, Artificial Sequence
  Description of Artificial Sequence: Synthetic oligonucleotide
  Target: AGXT; (+) strand; PAM type: YTN; PAM sequence: TTC
attgcatcctcgtgtcaatc

SEQ ID NO: 18515 - DNA, 20 bp, Artificial Sequence
  Description of Artificial Sequence: Synthetic oligonucleotide
  Target: AGXT; (+) strand; PAM type: YTN; PAM sequence: TTG
catcctcgtgtcaatcccat

SEQ ID NO: 18516 - DNA, 20 bp, Artificial Sequence
  Description of Artificial Sequence: Synthetic oligonucleotide
  Target: AGXT; (+) strand; PAM type: YTN; PAM sequence: CTC
gtgtcaatcccatgctgttg

SEQ ID NO: 18517 - DNA, 20 bp, Artificial Sequence
  Description of Artificial Sequence: Synthetic oligonucleotide
  Target: AGXT; (+) strand; PAM type: YTN; PAM sequence: CTG
ttgcaaatattgtagcttta

SEQ ID NO: 18518 - DNA, 20 bp, Artificial Sequence
  Description of Artificial Sequence: Synthetic oligonucleotide
  Target: AGXT; (+) strand; PAM type: YTN; PAM sequence: TTG
caaatattgtagctttacaa

SEQ ID NO: 18519 - DNA, 20 bp, Artificial Sequence
  Description of Artificial Sequence: Synthetic oligonucleotide
  Target: AGXT; (+) strand; PAM type: YTN; PAM sequence: TTG
tagctttacaataactcttg

SEQ ID NO: 18520 - DNA, 20 bp, Artificial Sequence
  Description of Artificial Sequence: Synthetic oligonucleotide
  Target: AGXT; (+) strand; PAM type: YTN; PAM sequence: CTT
tacaataactcttgaaatta

SEQ ID NO: 18521 - DNA, 20 bp, Artificial Sequence
  Description of Artificial Sequence: Synthetic oligonucleotide
  Target: AGXT; (+) strand; PAM type: YTN; PAM sequence: TTT
acaataactcttgaaattaa

SEQ ID NO: 18522 - DNA, 20 bp, Artificial Sequence
  Description of Artificial Sequence: Synthetic oligonucleotide
  Target: AGXT; (+) strand; PAM type: YTN; PAM sequence: TTA
caataactcttgaaattaag

SEQ ID NO: 18523 - DNA, 20 bp, Artificial Sequence
  Description of Artificial Sequence: Synthetic oligonucleotide
  Target: AGXT; (+) strand; PAM type: YTN; PAM sequence: CTC
ttgaaattaagaacaagtcc

SEQ ID NO: 18524 - DNA, 20 bp, Artificial Sequence
  Description of Artificial Sequence: Synthetic oligonucleotide
  Target: AGXT; (+) strand; PAM type: YTN; PAM sequence: CTT
gaaattaagaacaagtcctc

SEQ ID NO: 18525 - DNA, 20 bp, Artificial Sequence
  Description of Artificial Sequence: Synthetic oligonucleotide
  Target: AGXT; (+) strand; PAM type: YTN; PAM sequence: TTG
aaattaagaacaagtcctcc

SEQ ID NO: 18526 - DNA, 20 bp, Artificial Sequence
  Description of Artificial Sequence: Synthetic oligonucleotide
  Target: AGXT; (+) strand; PAM type: YTN; PAM sequence: TTA
agaacaagtcctccaatgtt

SEQ ID NO: 18527 - DNA, 20 bp, Artificial Sequence
  Description of Artificial Sequence: Synthetic oligonucleotide
  Target: AGXT; (+) strand; PAM type: YTN; PAM sequence: CTC
caatgtttttctccctttta

SEQ ID NO: 18528 - DNA, 20 bp, Artificial Sequence
  Description of Artificial Sequence: Synthetic oligonucleotide
  Target: AGXT; (+) strand; PAM type: YTN; PAM sequence: TTT
ttctcccttttaaaggtttt

SEQ ID NO: 18529 - DNA, 20 bp, Artificial Sequence
  Description of Artificial Sequence: Synthetic oligonucleotide
  Target: AGXT; (+) strand; PAM type: YTN; PAM sequence: TTT
tctcccttttaaaggttttt

SEQ ID NO: 18530 - DNA, 20 bp, Artificial Sequence
  Description of Artificial Sequence: Synthetic oligonucleotide
  Target: AGXT; (+) strand; PAM type: YTN; PAM sequence: TTT
ctcccttttaaaggtttttt

SEQ ID NO: 18531 - DNA, 20 bp, Artificial Sequence
  Description of Artificial Sequence: Synthetic oligonucleotide
  Target: AGXT; (+) strand; PAM type: YTN; PAM sequence: TTC
tcccttttaaaggttttttg

SEQ ID NO: 18532 - DNA, 20 bp, Artificial Sequence
  Description of Artificial Sequence: Synthetic oligonucleotide
  Target: AGXT; (+) strand; PAM type: YTN; PAM sequence: CTC
ccttttaaaggttttttgta

SEQ ID NO: 18533 - DNA, 20 bp, Artificial Sequence
  Description of Artificial Sequence: Synthetic oligonucleotide
  Target: AGXT; (+) strand; PAM type: YTN; PAM sequence: CTT
ttaaaggttttttgtattct

SEQ ID NO: 18534 - DNA, 20 bp, Artificial Sequence
  Description of Artificial Sequence: Synthetic oligonucleotide
  Target: AGXT; (+) strand; PAM type: YTN; PAM sequence: TTT
taaaggttttttgtattcta

SEQ ID NO: 18535 - DNA, 20 bp, Artificial Sequence
  Description of Artificial Sequence: Synthetic oligonucleotide
  Target: AGXT; (+) strand; PAM type: YTN; PAM sequence: TTT
aaaggttttttgtattctac

SEQ ID NO: 18536 - DNA, 20 bp, Artificial Sequence
  Description of Artificial Sequence: Synthetic oligonucleotide
  Target: AGXT; (+) strand; PAM type: YTN; PAM sequence: TTA
aaggttttttgtattctaca

SEQ ID NO: 18537 - DNA, 20 bp, Artificial Sequence
  Description of Artificial Sequence: Synthetic oligonucleotide
  Target: AGXT; (+) strand; PAM type: YTN; PAM sequence: TTT
tttgtattctacatcctttg

SEQ ID NO: 18538 - DNA, 20 bp, Artificial Sequence
  Description of Artificial Sequence: Synthetic oligonucleotide
  Target: AGXT; (+) strand; PAM type: YTN; PAM sequence: TTT
ttgtattctacatcctttga

SEQ ID NO: 18539 - DNA, 20 bp, Artificial Sequence
  Description of Artificial Sequence: Synthetic oligonucleotide
  Target: AGXT; (+) strand; PAM type: YTN; PAM sequence: TTT
tgtattctacatcctttgaa

SEQ ID NO: 18540 - DNA, 20 bp, Artificial Sequence
  Description of Artificial Sequence: Synthetic oligonucleotide
  Target: AGXT; (+) strand; PAM type: YTN; PAM sequence: TTT
gtattctacatcctttgaat

SEQ ID NO: 18541 - DNA, 20 bp, Artificial Sequence
  Description of Artificial Sequence: Synthetic oligonucleotide
  Target: AGXT; (+) strand; PAM type: YTN; PAM sequence: TTG
tattctacatcctttgaatt

SEQ ID NO: 18542 - DNA, 20 bp, Artificial Sequence
  Description of Artificial Sequence: Synthetic oligonucleotide
  Target: AGXT; (+) strand; PAM type: YTN; PAM sequence: TTC
tacatcctttgaatttctgt

SEQ ID NO: 18543 - DNA, 20 bp, Artificial Sequence
  Description of Artificial Sequence: Synthetic oligonucleotide
  Target: AGXT; (+) strand; PAM type: YTN; PAM sequence: CTA
catcctttgaatttctgtgt

SEQ ID NO: 18544 - DNA, 20 bp, Artificial Sequence
  Description of Artificial Sequence: Synthetic oligonucleotide
  Target: AGXT; (+) strand; PAM type: YTN; PAM sequence: CTT
tgaatttctgtgtacgtttt

SEQ ID NO: 18545 - DNA, 20 bp, Artificial Sequence
  Description of Artificial Sequence: Synthetic oligonucleotide
  Target: AGXT; (+) strand; PAM type: YTN; PAM sequence: TTT
gaatttctgtgtacgtttta

SEQ ID NO: 18546 - DNA, 20 bp, Artificial Sequence
  Description of Artificial Sequence: Synthetic oligonucleotide
  Target: AGXT; (+) strand; PAM type: YTN; PAM sequence: TTG
aatttctgtgtacgttttag

SEQ ID NO: 18547 - DNA, 20 bp, Artificial Sequence
  Description of Artificial Sequence: Synthetic oligonucleotide
  Target: AGXT; (+) strand; PAM type: YTN; PAM sequence: TTT
ctgtgtacgttttagattca

SEQ ID NO: 18548 - DNA, 20 bp, Artificial Sequence
  Description of Artificial Sequence: Synthetic oligonucleotide
  Target: AGXT; (+) strand; PAM type: YTN; PAM sequence: TTC
tgtgtacgttttagattcat

SEQ ID NO: 18549 - DNA, 20 bp, Artificial Sequence
  Description of Artificial Sequence: Synthetic oligonucleotide
  Target: AGXT; (+) strand; PAM type: YTN; PAM sequence: CTG
tgtacgttttagattcatgt

SEQ ID NO: 18550 - DNA, 20 bp, Artificial Sequence
  Description of Artificial Sequence: Synthetic oligonucleotide
  Target: AGXT; (+) strand; PAM type: YTN; PAM sequence: TTT
tagattcatgttgtctattt

SEQ ID NO: 18551 - DNA, 20 bp, Artificial Sequence
  Description of Artificial Sequence: Synthetic oligonucleotide
  Target: AGXT; (+) strand; PAM type: YTN; PAM sequence: TTT
agattcatgttgtctatttc

SEQ ID NO: 18552 - DNA, 20 bp, Artificial Sequence
  Description of Artificial Sequence: Synthetic oligonucleotide
  Target: AGXT; (+) strand; PAM type: YTN; PAM sequence: TTA
gattcatgttgtctatttct

SEQ ID NO: 18553 - DNA, 20 bp, Artificial Sequence
  Description of Artificial Sequence: Synthetic oligonucleotide
  Target: AGXT; (+) strand; PAM type: YTN; PAM sequence: TTC
atgttgtctatttcttcaga

SEQ ID NO: 18554 - DNA, 20 bp, Artificial Sequence
  Description of Artificial Sequence: Synthetic oligonucleotide
  Target: AGXT; (+) strand; PAM type: YTN; PAM sequence: TTG
tctatttcttcagaatagct

SEQ ID NO: 18555 - DNA, 20 bp, Artificial Sequence
  Description of Artificial Sequence: Synthetic oligonucleotide
  Target: AGXT; (+) strand; PAM type: YTN; PAM sequence: CTA
tttcttcagaatagcttgct

SEQ ID NO: 18556 - DNA, 20 bp, Artificial Sequence
  Description of Artificial Sequence: Synthetic oligonucleotide
  Target: AGXT; (+) strand; PAM type: YTN; PAM sequence: TTT
cttcagaatagcttgctgaa

SEQ ID NO: 18557 - DNA, 20 bp, Artificial Sequence
  Description of Artificial Sequence: Synthetic oligonucleotide
  Target: AGXT; (+) strand; PAM type: YTN; PAM sequence: TTC
ttcagaatagcttgctgaaa

SEQ ID NO: 18558 - DNA, 20 bp, Artificial Sequence
  Description of Artificial Sequence: Synthetic oligonucleotide
  Target: AGXT; (+) strand; PAM type: YTN; PAM sequence: CTT
cagaatagcttgctgaaatt

SEQ ID NO: 18559 - DNA, 20 bp, Artificial Sequence
  Description of Artificial Sequence: Synthetic oligonucleotide
  Target: AGXT; (+) strand; PAM type: YTN; PAM sequence: TTC
agaatagcttgctgaaattt

SEQ ID NO: 18560 - DNA, 20 bp, Artificial Sequence
  Description of Artificial Sequence: Synthetic oligonucleotide
  Target: AGXT; (+) strand; PAM type: YTN; PAM sequence: CTT
gctgaaattttggtaggaac

SEQ ID NO: 18561 - DNA, 20 bp, Artificial Sequence
  Description of Artificial Sequence: Synthetic oligonucleotide
  Target: AGXT; (+) strand; PAM type: YTN; PAM sequence: TTG
ctgaaattttggtaggaact

SEQ ID NO: 18562 - DNA, 20 bp, Artificial Sequence
  Description of Artificial Sequence: Synthetic oligonucleotide
  Target: AGXT; (+) strand; PAM type: YTN; PAM sequence: CTG
aaattttggtaggaactgca

SEQ ID NO: 18563 - DNA, 20 bp, Artificial Sequence
  Description of Artificial Sequence: Synthetic oligonucleotide
  Target: AGXT; (+) strand; PAM type: YTN; PAM sequence: TTT
tggtaggaactgcaccaaat

SEQ ID NO: 18564 - DNA, 20 bp, Artificial Sequence
  Description of Artificial Sequence: Synthetic oligonucleotide
  Target: AGXT; (+) strand; PAM type: YTN; PAM sequence: TTT
ggtaggaactgcaccaaatc

SEQ ID NO: 18565 - DNA, 20 bp, Artificial Sequence
  Description of Artificial Sequence: Synthetic oligonucleotide
  Target: AGXT; (+) strand; PAM type: YTN; PAM sequence: TTG
gtaggaactgcaccaaatct

SEQ ID NO: 18566 - DNA, 20 bp, Artificial Sequence
  Description of Artificial Sequence: Synthetic oligonucleotide
  Target: AGXT; (+) strand; PAM type: YTN; PAM sequence: CTG
caccaaatctatatatcaag

SEQ ID NO: 18567 - DNA, 20 bp, Artificial Sequence
  Description of Artificial Sequence: Synthetic oligonucleotide
  Target: AGXT; (+) strand; PAM type: YTN; PAM sequence: CTA
tatatcaagttaaggaaaat

SEQ ID NO: 18568 - DNA, 20 bp, Artificial Sequence
  Description of Artificial Sequence: Synthetic oligonucleotide
  Target: AGXT; (+) strand; PAM type: YTN; PAM sequence: TTA
aggaaaatggaaataaagta

SEQ ID NO: 18569 - DNA, 20 bp, Artificial Sequence
  Description of Artificial Sequence: Synthetic oligonucleotide
  Target: AGXT; (+) strand; PAM type: YTN; PAM sequence: TTC
catttcacaaacagaaatgt

SEQ ID NO: 18570 - DNA, 20 bp, Artificial Sequence
  Description of Artificial Sequence: Synthetic oligonucleotide
  Target: AGXT; (+) strand; PAM type: YTN; PAM sequence: TTT
cacaaacagaaatgtaagta

SEQ ID NO: 18571 - DNA, 20 bp, Artificial Sequence
  Description of Artificial Sequence: Synthetic oligonucleotide
  Target: AGXT; (+) strand; PAM type: YTN; PAM sequence: TTC
acaaacagaaatgtaagtat

SEQ ID NO: 18572 - DNA, 20 bp, Artificial Sequence
  Description of Artificial Sequence: Synthetic oligonucleotide
  Target: AGXT; (+) strand; PAM type: YTN; PAM sequence: TTT
taaaattactttcagcaatg

SEQ ID NO: 18573 - DNA, 20 bp, Artificial Sequence
  Description of Artificial Sequence: Synthetic oligonucleotide
  Target: AGXT; (+) strand; PAM type: YTN; PAM sequence: TTT
aaaattactttcagcaatgt

SEQ ID NO: 18574 - DNA, 20 bp, Artificial Sequence
  Description of Artificial Sequence: Synthetic oligonucleotide
  Target: AGXT; (+) strand; PAM type: YTN; PAM sequence: TTA
aaattactttcagcaatgtt

SEQ ID NO: 18575 - DNA, 20 bp, Artificial Sequence
  Description of Artificial Sequence: Synthetic oligonucleotide
  Target: AGXT; (+) strand; PAM type: YTN; PAM sequence: TTA
ctttcagcaatgtttctagt

SEQ ID NO: 18576 - DNA, 20 bp, Artificial Sequence
  Description of Artificial Sequence: Synthetic oligonucleotide
  Target: AGXT; (+) strand; PAM type: YTN; PAM sequence: CTT
tcagcaatgtttctagtttt

SEQ ID NO: 18577 - DNA, 20 bp, Artificial Sequence
  Description of Artificial Sequence: Synthetic oligonucleotide
  Target: AGXT; (+) strand; PAM type: YTN; PAM sequence: TTT
cagcaatgtttctagttttc

SEQ ID NO: 18578 - DNA, 20 bp, Artificial Sequence
  Description of Artificial Sequence: Synthetic oligonucleotide
  Target: AGXT; (+) strand; PAM type: YTN; PAM sequence: TTC
agcaatgtttctagttttca

SEQ ID NO: 18579 - DNA, 20 bp, Artificial Sequence
  Description of Artificial Sequence: Synthetic oligonucleotide
  Target: AGXT; (+) strand; PAM type: YTN; PAM sequence: TTT
ctagttttcaacatacagca

SEQ ID NO: 18580 - DNA, 20 bp, Artificial Sequence
  Description of Artificial Sequence: Synthetic oligonucleotide
  Target: AGXT; (+) strand; PAM type: YTN; PAM sequence: TTC
tagttttcaacatacagcaa

SEQ ID NO: 18581 - DNA, 20 bp, Artificial Sequence
  Description of Artificial Sequence: Synthetic oligonucleotide
  Target: AGXT; (+) strand; PAM type: YTN; PAM sequence: CTA
gttttcaacatacagcaaag

SEQ ID NO: 18582 - DNA, 20 bp, Artificial Sequence
  Description of Artificial Sequence: Synthetic oligonucleotide
  Target: AGXT; (+) strand; PAM type: YTN; PAM sequence: TTT
tcaacatacagcaaagtggg

SEQ ID NO: 18583 - DNA, 20 bp, Artificial Sequence
  Description of Artificial Sequence: Synthetic oligonucleotide
  Target: AGXT; (+) strand; PAM type: YTN; PAM sequence: TTT
caacatacagcaaagtggga

SEQ ID NO: 18584 - DNA, 20 bp, Artificial Sequence
  Description of Artificial Sequence: Synthetic oligonucleotide
  Target: AGXT; (+) strand; PAM type: YTN; PAM sequence: TTC
aacatacagcaaagtgggag

SEQ ID NO: 18585 - DNA, 20 bp, Artificial Sequence
  Description of Artificial Sequence: Synthetic oligonucleotide
  Target: AGXT; (+) strand; PAM type: YTN; PAM sequence: TTA
tttaaggaaagccaggaacc

SEQ ID NO: 18586 - DNA, 20 bp, Artificial Sequence
  Description of Artificial Sequence: Synthetic oligonucleotide
  Target: AGXT; (+) strand; PAM type: YTN; PAM sequence: TTT
aaggaaagccaggaacccag

SEQ ID NO: 18587 - DNA, 20 bp, Artificial Sequence
  Description of Artificial Sequence: Synthetic oligonucleotide
  Target: AGXT; (+) strand; PAM type: YTN; PAM sequence: TTA
aggaaagccaggaacccagg

SEQ ID NO: 18588 - DNA, 20 bp, Artificial Sequence
  Description of Artificial Sequence: Synthetic oligonucleotide
  Target: AGXT; (+) strand; PAM type: YTN; PAM sequence: CTG
atccagcccaggaggcagga

SEQ ID NO: 18589 - DNA, 20 bp, Artificial Sequence
  Description of Artificial Sequence: Synthetic oligonucleotide
  Target: AGXT; (+) strand; PAM type: YTN; PAM sequence: CTC
cccggcccccagcggccctt

SEQ ID NO: 18590 - DNA, 20 bp, Artificial Sequence
  Description of Artificial Sequence: Synthetic oligonucleotide
  Target: AGXT; (+) strand; PAM type: YTN; PAM sequence: CTT
ctccctccaagtagaacctc

SEQ ID NO: 18591 - DNA, 20 bp, Artificial Sequence
  Description of Artificial Sequence: Synthetic oligonucleotide
  Target: AGXT; (+) strand; PAM type: YTN; PAM sequence: TTC
tccctccaagtagaacctcc

SEQ ID NO: 18592 - DNA, 20 bp, Artificial Sequence
  Description of Artificial Sequence: Synthetic oligonucleotide
  Target: AGXT; (+) strand; PAM type: YTN; PAM sequence: CTC
cctccaagtagaacctcctg

SEQ ID NO: 18593 - DNA, 20 bp, Artificial Sequence
  Description of Artificial Sequence: Synthetic oligonucleotide
  Target: AGXT; (+) strand; PAM type: YTN; PAM sequence: CTC
caagtagaacctcctggaaa

SEQ ID NO: 18594 - DNA, 20 bp, Artificial Sequence
  Description of Artificial Sequence: Synthetic oligonucleotide
  Target: AGXT; (+) strand; PAM type: YTN; PAM sequence: CTC
ctggaaacagcccacttggg

SEQ ID NO: 18595 - DNA, 20 bp, Artificial Sequence
  Description of Artificial Sequence: Synthetic oligonucleotide
  Target: AGXT; (+) strand; PAM type: YTN; PAM sequence: CTG
gaaacagcccacttgggcgt

SEQ ID NO: 18596 - DNA, 20 bp, Artificial Sequence
  Description of Artificial Sequence: Synthetic oligonucleotide
  Target: AGXT; (+) strand; PAM type: YTN; PAM sequence: CTT
gggcgtagatcttttgttag

SEQ ID NO: 18597 - DNA, 20 bp, Artificial Sequence
  Description of Artificial Sequence: Synthetic oligonucleotide
  Target: AGXT; (+) strand; PAM type: YTN; PAM sequence: TTG
ggcgtagatcttttgttaga

SEQ ID NO: 18598 - DNA, 20 bp, Artificial Sequence
  Description of Artificial Sequence: Synthetic oligonucleotide
  Target: AGXT; (+) strand; PAM type: YTN; PAM sequence: CTT
ttgttagatttattcctagg

SEQ ID NO: 18599 - DNA, 20 bp, Artificial Sequence
  Description of Artificial Sequence: Synthetic oligonucleotide
  Target: AGXT; (+) strand; PAM type: YTN; PAM sequence: TTT
tgttagatttattcctaggt

SEQ ID NO: 18600 - DNA, 20 bp, Artificial Sequence
  Description of Artificial Sequence: Synthetic oligonucleotide
  Target: AGXT; (+) strand; PAM type: YTN; PAM sequence: TTT
gttagatttattcctaggtg

SEQ ID NO: 18601 - DNA, 20 bp, Artificial Sequence
  Description of Artificial Sequence: Synthetic oligonucleotide
  Target: AGXT; (+) strand; PAM type: YTN; PAM sequence: TTG
ttagatttattcctaggtgt

SEQ ID NO: 18602 - DNA, 20 bp, Artificial Sequence
  Description of Artificial Sequence: Synthetic oligonucleotide
  Target: AGXT; (+) strand; PAM type: YTN; PAM sequence: TTA
gatttattcctaggtgtttg

SEQ ID NO: 18603 - DNA, 20 bp, Artificial Sequence
  Description of Artificial Sequence: Synthetic oligonucleotide
  Target: AGXT; (+) strand; PAM type: YTN; PAM sequence: TTT
attcctaggtgtttgatctt

SEQ ID NO: 18604 - DNA, 20 bp, Artificial Sequence
  Description of Artificial Sequence: Synthetic oligonucleotide
  Target: AGXT; (+) strand; PAM type: YTN; PAM sequence: TTA
ttcctaggtgtttgatcttg

SEQ ID NO: 18605 - DNA, 20 bp, Artificial Sequence
  Description of Artificial Sequence: Synthetic oligonucleotide
  Target: AGXT; (+) strand; PAM type: YTN; PAM sequence: TTC
ctaggtgtttgatcttgttg

SEQ ID NO: 18606 - DNA, 20 bp, Artificial Sequence
  Description of Artificial Sequence: Synthetic oligonucleotide
  Target: AGXT; (+) strand; PAM type: YTN; PAM sequence: CTA
ggtgtttgatcttgttgatg

SEQ ID NO: 18607 - DNA, 20 bp, Artificial Sequence
  Description of Artificial Sequence: Synthetic oligonucleotide
  Target: AGXT; (+) strand; PAM type: YTN; PAM sequence: TTT
gatcttgttgatgctgttat

SEQ ID NO: 18608 - DNA, 20 bp, Artificial Sequence
  Description of Artificial Sequence: Synthetic oligonucleotide
  Target: AGXT; (+) strand; PAM type: YTN; PAM sequence: TTG
atcttgttgatgctgttata

SEQ ID NO: 18609 - DNA, 20 bp, Artificial Sequence
  Description of Artificial Sequence: Synthetic oligonucleotide
  Target: AGXT; (+) strand; PAM type: YTN; PAM sequence: CTT
gttgatgctgttataaatgg

SEQ ID NO: 18610 - DNA, 20 bp, Artificial Sequence
  Description of Artificial Sequence: Synthetic oligonucleotide
  Target: AGXT; (+) strand; PAM type: YTN; PAM sequence: TTG
ttgatgctgttataaatggc

SEQ ID NO: 18611 - DNA, 20 bp, Artificial Sequence
  Description of Artificial Sequence: Synthetic oligonucleotide
  Target: AGXT; (+) strand; PAM type: YTN; PAM sequence: TTG
atgctgttataaatggcatt

SEQ ID NO: 18612 - DNA, 20 bp, Artificial Sequence
  Description of Artificial Sequence: Synthetic oligonucleotide
  Target: AGXT; (+) strand; PAM type: YTN; PAM sequence: CTG
ttataaatggcatttgaaaa

SEQ ID NO: 18613 - DNA, 20 bp, Artificial Sequence
  Description of Artificial Sequence: Synthetic oligonucleotide
  Target: AGXT; (+) strand; PAM type: YTN; PAM sequence: TTA
taaatggcatttgaaaattt

SEQ ID NO: 18614 - DNA, 20 bp, Artificial Sequence
  Description of Artificial Sequence: Synthetic oligonucleotide
  Target: AGXT; (+) strand; PAM type: YTN; PAM sequence: TTT
gaaaattttcatttccagtt

SEQ ID NO: 18615 - DNA, 20 bp, Artificial Sequence
  Description of Artificial Sequence: Synthetic oligonucleotide
  Target: AGXT; (+) strand; PAM type: YTN; PAM sequence: TTG
aaaattttcatttccagttg

SEQ ID NO: 18616 - DNA, 20 bp, Artificial Sequence
  Description of Artificial Sequence: Synthetic oligonucleotide
  Target: AGXT; (+) strand; PAM type: YTN; PAM sequence: TTT
tcatttccagttgtttattt

SEQ ID NO: 18617 - DNA, 20 bp, Artificial Sequence
  Description of Artificial Sequence: Synthetic oligonucleotide
  Target: AGXT; (+) strand; PAM type: YTN; PAM sequence: TTT
catttccagttgtttatttt

SEQ ID NO: 18618 - DNA, 20 bp, Artificial Sequence
  Description of Artificial Sequence: Synthetic oligonucleotide
  Target: AGXT; (+) strand; PAM type: YTN; PAM sequence: TTC
atttccagttgtttattttt

SEQ ID NO: 18619 - DNA, 20 bp, Artificial Sequence
  Description of Artificial Sequence: Synthetic oligonucleotide
  Target: AGXT; (+) strand; PAM type: YTN; PAM sequence: TTT
ccagttgtttattttttaat

SEQ ID NO: 18620 - DNA, 20 bp, Artificial Sequence
  Description of Artificial Sequence: Synthetic oligonucleotide
  Target: AGXT; (+) strand; PAM type: YTN; PAM sequence: TTC
cagttgtttattttttaata

SEQ ID NO: 18621 - DNA, 20 bp, Artificial Sequence
  Description of Artificial Sequence: Synthetic oligonucleotide
  Target: AGXT; (+) strand; PAM type: YTN; PAM sequence: TTG
tttattttttaatatataat

SEQ ID NO: 18622 - DNA, 20 bp, Artificial Sequence
  Description of Artificial Sequence: Synthetic oligonucleotide
  Target: AGXT; (+) strand; PAM type: YTN; PAM sequence: TTT
attttttaatatataatctc

SEQ ID NO: 18623 - DNA, 20 bp, Artificial Sequence
  Description of Artificial Sequence: Synthetic oligonucleotide
  Target: AGXT; (+) strand; PAM type: YTN; PAM sequence: TTA
ttttttaatatataatctca

SEQ ID NO: 18624 - DNA, 20 bp, Artificial Sequence
  Description of Artificial Sequence: Synthetic oligonucleotide
  Target: AGXT; (+) strand; PAM type: YTN; PAM sequence: TTT
tttaatatataatctcattt

SEQ ID NO: 18625 - DNA, 20 bp, Artificial Sequence
  Description of Artificial Sequence: Synthetic oligonucleotide
  Target: AGXT; (+) strand; PAM type: YTN; PAM sequence: TTT
ttaatatataatctcatttt

SEQ ID NO: 18626 - DNA, 20 bp, Artificial Sequence
  Description of Artificial Sequence: Synthetic oligonucleotide
  Target: AGXT; (+) strand; PAM type: YTN; PAM sequence: TTT
taatatataatctcattttt

SEQ ID NO: 18627 - DNA, 20 bp, Artificial Sequence
  Description of Artificial Sequence: Synthetic oligonucleotide
  Target: AGXT; (+) strand; PAM type: YTN; PAM sequence: TTT
aatatataatctcatttttt

SEQ ID NO: 18628 - DNA, 20 bp, Artificial Sequence
  Description of Artificial Sequence: Synthetic oligonucleotide
  Target: AGXT; (+) strand; PAM type: YTN; PAM sequence: TTA
atatataatctcattttttt

SEQ ID NO: 18629 - DNA, 20 bp, Artificial Sequence
  Description of Artificial Sequence: Synthetic oligonucleotide
  Target: AGXT; (+) strand; PAM type: YTN; PAM sequence: CTC
atttttttctatattaattt

SEQ ID NO: 18630 - DNA, 20 bp, Artificial Sequence
  Description of Artificial Sequence: Synthetic oligonucleotide
  Target: AGXT; (+) strand; PAM type: YTN; PAM sequence: TTT
ttttctatattaattttgta

SEQ ID NO: 18631 - DNA, 20 bp, Artificial Sequence
  Description of Artificial Sequence: Synthetic oligonucleotide
  Target: AGXT; (+) strand; PAM type: YTN; PAM sequence: TTT
tttctatattaattttgtat

SEQ ID NO: 18632 - DNA, 20 bp, Artificial Sequence
  Description of Artificial Sequence: Synthetic oligonucleotide
  Target: AGXT; (+) strand; PAM type: YTN; PAM sequence: TTT
ttctatattaattttgtatc

SEQ ID NO: 18633 - DNA, 20 bp, Artificial Sequence
  Description of Artificial Sequence: Synthetic oligonucleotide
  Target: AGXT; (+) strand; PAM type: YTN; PAM sequence: TTT
tctatattaattttgtatct

SEQ ID NO: 18634 - DNA, 20 bp, Artificial Sequence
  Description of Artificial Sequence: Synthetic oligonucleotide
  Target: AGXT; (+) strand; PAM type: YTN; PAM sequence: TTT
ctatattaattttgtatctt

SEQ ID NO: 18635 - DNA, 20 bp, Artificial Sequence
  Description of Artificial Sequence: Synthetic oligonucleotide
  Target: AGXT; (+) strand; PAM type: YTN; PAM sequence: TTC
tatattaattttgtatcttc

SEQ ID NO: 18636 - DNA, 20 bp, Artificial Sequence
  Description of Artificial Sequence: Synthetic oligonucleotide
  Target: AGXT; (+) strand; PAM type: YTN; PAM sequence: CTA
tattaattttgtatcttctg

SEQ ID NO: 18637 - DNA, 20 bp, Artificial Sequence
  Description of Artificial Sequence: Synthetic oligonucleotide
  Target: AGXT; (+) strand; PAM type: YTN; PAM sequence: TTA
attttgtatcttctgacctt

SEQ ID NO: 18638 - DNA, 20 bp, Artificial Sequence
  Description of Artificial Sequence: Synthetic oligonucleotide
  Target: AGXT; (+) strand; PAM type: YTN; PAM sequence: TTT
tgtatcttctgaccttccta

SEQ ID NO: 18639 - DNA, 20 bp, Artificial Sequence
  Description of Artificial Sequence: Synthetic oligonucleotide
  Target: AGXT; (+) strand; PAM type: YTN; PAM sequence: TTT
gtatcttctgaccttcctaa

SEQ ID NO: 18640 - DNA, 20 bp, Artificial Sequence
  Description of Artificial Sequence: Synthetic oligonucleotide
  Target: AGXT; (+) strand; PAM type: YTN; PAM sequence: TTG
tatcttctgaccttcctaaa

SEQ ID NO: 18641 - DNA, 20 bp, Artificial Sequence
  Description of Artificial Sequence: Synthetic oligonucleotide
  Target: AGXT; (+) strand; PAM type: YTN; PAM sequence: CTT
ctgaccttcctaaattcaca

SEQ ID NO: 18642 - DNA, 20 bp, Artificial Sequence
  Description of Artificial Sequence: Synthetic oligonucleotide
  Target: AGXT; (+) strand; PAM type: YTN; PAM sequence: TTC
tgaccttcctaaattcacaa

SEQ ID NO: 18643 - DNA, 20 bp, Artificial Sequence
  Description of Artificial Sequence: Synthetic oligonucleotide
  Target: AGXT; (+) strand; PAM type: YTN; PAM sequence: CTG
accttcctaaattcacaagg

SEQ ID NO: 18644 - DNA, 20 bp, Artificial Sequence
  Description of Artificial Sequence: Synthetic oligonucleotide
  Target: AGXT; (+) strand; PAM type: YTN; PAM sequence: CTT
cctaaattcacaaggcctag

SEQ ID NO: 18645 - DNA, 20 bp, Artificial Sequence
  Description of Artificial Sequence: Synthetic oligonucleotide
  Target: AGXT; (+) strand; PAM type: YTN; PAM sequence: TTC
ctaaattcacaaggcctagt

SEQ ID NO: 18646 - DNA, 20 bp, Artificial Sequence
  Description of Artificial Sequence: Synthetic oligonucleotide
  Target: AGXT; (+) strand; PAM type: YTN; PAM sequence: CTA
aattcacaaggcctagtagc

SEQ ID NO: 18647 - DNA, 20 bp, Artificial Sequence
  Description of Artificial Sequence: Synthetic oligonucleotide
  Target: AGXT; (+) strand; PAM type: YTN; PAM sequence: TTC
acaaggcctagtagcttctt

SEQ ID NO: 18648 - DNA, 20 bp, Artificial Sequence
  Description of Artificial Sequence: Synthetic oligonucleotide
  Target: AGXT; (+) strand; PAM type: YTN; PAM sequence: CTA
gtagcttctttgtagattcc

SEQ ID NO: 18649 - DNA, 20 bp, Artificial Sequence
  Description of Artificial Sequence: Synthetic oligonucleotide
  Target: AGXT; (+) strand; PAM type: YTN; PAM sequence: CTT
ctttgtagattcctttaaat

SEQ ID NO: 18650 - DNA, 20 bp, Artificial Sequence
  Description of Artificial Sequence: Synthetic oligonucleotide
  Target: AGXT; (+) strand; PAM type: YTN; PAM sequence: TTC
tttgtagattcctttaaatt

SEQ ID NO: 18651 - DNA, 20 bp, Artificial Sequence
  Description of Artificial Sequence: Synthetic oligonucleotide
  Target: AGXT; (+) strand; PAM type: YTN; PAM sequence: CTT
tgtagattcctttaaatttt

SEQ ID NO: 18652 - DNA, 20 bp, Artificial Sequence
  Description of Artificial Sequence: Synthetic oligonucleotide
  Target: AGXT; (+) strand; PAM type: YTN; PAM sequence: TTT
gtagattcctttaaattttc

SEQ ID NO: 18653 - DNA, 20 bp, Artificial Sequence
  Description of Artificial Sequence: Synthetic oligonucleotide
  Target: AGXT; (+) strand; PAM type: YTN; PAM sequence: TTG
tagattcctttaaattttct

SEQ ID NO: 18654 - DNA, 20 bp, Artificial Sequence
  Description of Artificial Sequence: Synthetic oligonucleotide
  Target: AGXT; (+) strand; PAM type: YTN; PAM sequence: TTC
ctttaaattttctaagtaga

SEQ ID NO: 18655 - DNA, 20 bp, Artificial Sequence
  Description of Artificial Sequence: Synthetic oligonucleotide
  Target: AGXT; (+) strand; PAM type: YTN; PAM sequence: CTT
taaattttctaagtagataa

SEQ ID NO: 18656 - DNA, 20 bp, Artificial Sequence
  Description of Artificial Sequence: Synthetic oligonucleotide
  Target: AGXT; (+) strand; PAM type: YTN; PAM sequence: TTT
aaattttctaagtagataat

SEQ ID NO: 18657 - DNA, 20 bp, Artificial Sequence
  Description of Artificial Sequence: Synthetic oligonucleotide
  Target: AGXT; (+) strand; PAM type: YTN; PAM sequence: TTA
aattttctaagtagataatc

SEQ ID NO: 18658 - DNA, 20 bp, Artificial Sequence
  Description of Artificial Sequence: Synthetic oligonucleotide
  Target: AGXT; (+) strand; PAM type: YTN; PAM sequence: TTT
tctaagtagataatcaaact

SEQ ID NO: 18659 - DNA, 20 bp, Artificial Sequence
  Description of Artificial Sequence: Synthetic oligonucleotide
  Target: AGXT; (+) strand; PAM type: YTN; PAM sequence: TTT
ctaagtagataatcaaactc

SEQ ID NO: 18660 - DNA, 20 bp, Artificial Sequence
  Description of Artificial Sequence: Synthetic oligonucleotide
  Target: AGXT; (+) strand; PAM type: YTN; PAM sequence: TTC
taagtagataatcaaactct

SEQ ID NO: 18661 - DNA, 20 bp, Artificial Sequence
  Description of Artificial Sequence: Synthetic oligonucleotide
  Target: AGXT; (+) strand; PAM type: YTN; PAM sequence: CTA
agtagataatcaaactctct

SEQ ID NO: 18662 - DNA, 20 bp, Artificial Sequence
  Description of Artificial Sequence: Synthetic oligonucleotide
  Target: AGXT; (+) strand; PAM type: YTN; PAM sequence: CTC
tctgtgactaatgagagttg

SEQ ID NO: 18663 - DNA, 20 bp, Artificial Sequence
  Description of Artificial Sequence: Synthetic oligonucleotide
  Target: AGXT; (+) strand; PAM type: YTN; PAM sequence: CTC
tgtgactaatgagagttgta

SEQ ID NO: 18664 - DNA, 20 bp, Artificial Sequence
  Description of Artificial Sequence: Synthetic oligonucleotide
  Target: AGXT; (+) strand; PAM type: YTN; PAM sequence: CTG
tgactaatgagagttgtaca

SEQ ID NO: 18665 - DNA, 20 bp, Artificial Sequence
  Description of Artificial Sequence: Synthetic oligonucleotide
  Target: AGXT; (+) strand; PAM type: YTN; PAM sequence: CTA
atgagagttgtacatcttct

SEQ ID NO: 18666 - DNA, 20 bp, Artificial Sequence
  Description of Artificial Sequence: Synthetic oligonucleotide
  Target: AGXT; (+) strand; PAM type: YTN; PAM sequence: TTG
tacatcttctgccttttatg

SEQ ID NO: 18667 - DNA, 20 bp, Artificial Sequence
  Description of Artificial Sequence: Synthetic oligonucleotide
  Target: AGXT; (+) strand; PAM type: YTN; PAM sequence: CTT
ctgccttttatgtacttttt

SEQ ID NO: 18668 - DNA, 20 bp, Artificial Sequence
  Description of Artificial Sequence: Synthetic oligonucleotide
  Target: AGXT; (+) strand; PAM type: YTN; PAM sequence: TTC
tgccttttatgtactttttc

SEQ ID NO: 18669 - DNA, 20 bp, Artificial Sequence
  Description of Artificial Sequence: Synthetic oligonucleotide
  Target: AGXT; (+) strand; PAM type: YTN; PAM sequence: CTG
ccttttatgtactttttctt

SEQ ID NO: 18670 - DNA, 20 bp, Artificial Sequence
  Description of Artificial Sequence: Synthetic oligonucleotide
  Target: AGXT; (+) strand; PAM type: YTN; PAM sequence: CTT
ttatgtactttttcttgctt

SEQ ID NO: 18671 - DNA, 20 bp, Artificial Sequence
  Description of Artificial Sequence: Synthetic oligonucleotide
  Target: AGXT; (+) strand; PAM type: YTN; PAM sequence: TTT
tatgtactttttcttgcttc

SEQ ID NO: 18672 - DNA, 20 bp, Artificial Sequence
  Description of Artificial Sequence: Synthetic oligonucleotide
  Target: AGXT; (+) strand; PAM type: YTN; PAM sequence: TTT
atgtactttttcttgcttca

SEQ ID NO: 18673 - DNA, 20 bp, Artificial Sequence
  Description of Artificial Sequence: Synthetic oligonucleotide
  Target: AGXT; (+) strand; PAM type: YTN; PAM sequence: TTA
tgtactttttcttgcttcat

SEQ ID NO: 18674 - DNA, 20 bp, Artificial Sequence
  Description of Artificial Sequence: Synthetic oligonucleotide
  Target: AGXT; (+) strand; PAM type: YTN; PAM sequence: CTT
tttcttgcttcattgcaacg

SEQ ID NO: 18675 - DNA, 20 bp, Artificial Sequence
  Description of Artificial Sequence: Synthetic oligonucleotide
  Target: AGXT; (+) strand; PAM type: YTN; PAM sequence: TTT
ttcttgcttcattgcaacgg

SEQ ID NO: 18676 - DNA, 20 bp, Artificial Sequence
  Description of Artificial Sequence: Synthetic oligonucleotide
  Target: AGXT; (+) strand; PAM type: YTN; PAM sequence: TTT
tcttgcttcattgcaacggt

SEQ ID NO: 18677 - DNA, 20 bp, Artificial Sequence
  Description of Artificial Sequence: Synthetic oligonucleotide
  Target: AGXT; (+) strand; PAM type: YTN; PAM sequence: TTT
cttgcttcattgcaacggtg

SEQ ID NO: 18678 - DNA, 20 bp, Artificial Sequence
  Description of Artificial Sequence: Synthetic oligonucleotide
  Target: AGXT; (+) strand; PAM type: YTN; PAM sequence: TTC
ttgcttcattgcaacggtgt

SEQ ID NO: 18679 - DNA, 20 bp, Artificial Sequence
  Description of Artificial Sequence: Synthetic oligonucleotide
  Target: AGXT; (+) strand; PAM type: YTN; PAM sequence: CTT
gcttcattgcaacggtgtag

SEQ ID NO: 18680 - DNA, 20 bp, Artificial Sequence
  Description of Artificial Sequence: Synthetic oligonucleotide
  Target: AGXT; (+) strand; PAM type: YTN; PAM sequence: TTG
cttcattgcaacggtgtagg

SEQ ID NO: 18681 - DNA, 20 bp, Artificial Sequence
  Description of Artificial Sequence: Synthetic oligonucleotide
  Target: AGXT; (+) strand; PAM type: YTN; PAM sequence: CTT
cattgcaacggtgtaggcca

SEQ ID NO: 18682 - DNA, 20 bp, Artificial Sequence
  Description of Artificial Sequence: Synthetic oligonucleotide
  Target: AGXT; (+) strand; PAM type: YTN; PAM sequence: TTC
attgcaacggtgtaggccac

SEQ ID NO: 18683 - DNA, 20 bp, Artificial Sequence
  Description of Artificial Sequence: Synthetic oligonucleotide
  Target: AGXT; (+) strand; PAM type: YTN; PAM sequence: TTG
caacggtgtaggccacaaat

SEQ ID NO: 18684 - DNA, 20 bp, Artificial Sequence
  Description of Artificial Sequence: Synthetic oligonucleotide
  Target: AGXT; (+) strand; PAM type: YTN; PAM sequence: CTG
aatctcagtgatgagtgtgc

SEQ ID NO: 18685 - DNA, 20 bp, Artificial Sequence
  Description of Artificial Sequence: Synthetic oligonucleotide
  Target: AGXT; (+) strand; PAM type: YTN; PAM sequence: CTC
agtgatgagtgtgcaccttc

SEQ ID NO: 18686 - DNA, 20 bp, Artificial Sequence
  Description of Artificial Sequence: Synthetic oligonucleotide
  Target: AGXT; (+) strand; PAM type: YTN; PAM sequence: CTT
ctcgccttggagacgtgttt

SEQ ID NO: 18687 - DNA, 20 bp, Artificial Sequence
  Description of Artificial Sequence: Synthetic oligonucleotide
  Target: AGXT; (+) strand; PAM type: YTN; PAM sequence: TTC
tcgccttggagacgtgttta

SEQ ID NO: 18688 - DNA, 20 bp, Artificial Sequence
  Description of Artificial Sequence: Synthetic oligonucleotide
  Target: AGXT; (+) strand; PAM type: YTN; PAM sequence: CTC
gccttggagacgtgtttaat

SEQ ID NO: 18689 - DNA, 20 bp, Artificial Sequence
  Description of Artificial Sequence: Synthetic oligonucleotide
  Target: AGXT; (+) strand; PAM type: YTN; PAM sequence: CTT
ggagacgtgtttaatgtctc

SEQ ID NO: 18690 - DNA, 20 bp, Artificial Sequence
  Description of Artificial Sequence: Synthetic oligonucleotide
  Target: AGXT; (+) strand; PAM type: YTN; PAM sequence: TTG
gagacgtgtttaatgtctca

SEQ ID NO: 18691 - DNA, 20 bp, Artificial Sequence
  Description of Artificial Sequence: Synthetic oligonucleotide
  Target: AGXT; (+) strand; PAM type: YTN; PAM sequence: TTT
aatgtctcagcgtcaggctg

SEQ ID NO: 18692 - DNA, 20 bp, Artificial Sequence
  Description of Artificial Sequence: Synthetic oligonucleotide
  Target: AGXT; (+) strand; PAM type: YTN; PAM sequence: TTA
atgtctcagcgtcaggctga

SEQ ID NO: 18693 - DNA, 20 bp, Artificial Sequence
  Description of Artificial Sequence: Synthetic oligonucleotide
  Target: AGXT; (+) strand; PAM type: YTN; PAM sequence: CTC
agcgtcaggctgacggcagc

SEQ ID NO: 18694 - DNA, 20 bp, Artificial Sequence
  Description of Artificial Sequence: Synthetic oligonucleotide
  Target: AGXT; (+) strand; PAM type: YTN; PAM sequence: CTG
acggcagcagtggggtttct

SEQ ID NO: 18695 - DNA, 20 bp, Artificial Sequence
  Description of Artificial Sequence: Synthetic oligonucleotide
  Target: AGXT; (+) strand; PAM type: YTN; PAM sequence: TTT
ctgcagctgccctgctctca

SEQ ID NO: 18696 - DNA, 20 bp, Artificial Sequence
  Description of Artificial Sequence: Synthetic oligonucleotide
  Target: AGXT; (+) strand; PAM type: YTN; PAM sequence: TTC
tgcagctgccctgctctcac

SEQ ID NO: 18697 - DNA, 20 bp, Artificial Sequence
  Description of Artificial Sequence: Synthetic oligonucleotide
  Target: AGXT; (+) strand; PAM type: YTN; PAM sequence: CTG
cagctgccctgctctcacag

SEQ ID NO: 18698 - DNA, 20 bp, Artificial Sequence
  Description of Artificial Sequence: Synthetic oligonucleotide
  Target: AGXT; (+) strand; PAM type: YTN; PAM sequence: CTG
ccctgctctcacaggcagga

SEQ ID NO: 18699 - DNA, 20 bp, Artificial Sequence
  Description of Artificial Sequence: Synthetic oligonucleotide
  Target: AGXT; (+) strand; PAM type: YTN; PAM sequence: CTG
ctctcacaggcaggaagtcc

SEQ ID NO: 18700 - DNA, 20 bp, Artificial Sequence
  Description of Artificial Sequence: Synthetic oligonucleotide
  Target: AGXT; (+) strand; PAM type: YTN; PAM sequence: CTC
tcacaggcaggaagtcccca

SEQ ID NO: 18701 - DNA, 20 bp, Artificial Sequence
  Description of Artificial Sequence: Synthetic oligonucleotide
  Target: AGXT; (+) strand; PAM type: YTN; PAM sequence: CTC
acaggcaggaagtccccacc

SEQ ID NO: 18702 - DNA, 20 bp, Artificial Sequence
  Description of Artificial Sequence: Synthetic oligonucleotide
  Target: AGXT; (+) strand; PAM type: YTN; PAM sequence: CTG
tcctagtttgcagagggtat

SEQ ID NO: 18703 - DNA, 20 bp, Artificial Sequence
  Description of Artificial Sequence: Synthetic oligonucleotide
  Target: AGXT; (+) strand; PAM type: YTN; PAM sequence: CTA
gtttgcagagggtatttatc

SEQ ID NO: 18704 - DNA, 20 bp, Artificial Sequence
  Description of Artificial Sequence: Synthetic oligonucleotide
  Target: AGXT; (+) strand; PAM type: YTN; PAM sequence: TTT
gcagagggtatttatcacta

SEQ ID NO: 18705 - DNA, 20 bp, Artificial Sequence
  Description of Artificial Sequence: Synthetic oligonucleotide
  Target: AGXT; (+) strand; PAM type: YTN; PAM sequence: TTG
cagagggtatttatcactaa

SEQ ID NO: 18706 - DNA, 20 bp, Artificial Sequence
  Description of Artificial Sequence: Synthetic oligonucleotide
  Target: AGXT; (+) strand; PAM type: YTN; PAM sequence: TTT
atcactaacagctgttgtat

SEQ ID NO: 18707 - DNA, 20 bp, Artificial Sequence
  Description of Artificial Sequence: Synthetic oligonucleotide
  Target: AGXT; (+) strand; PAM type: YTN; PAM sequence: TTA
tcactaacagctgttgtatt

SEQ ID NO: 18708 - DNA, 20 bp, Artificial Sequence
  Description of Artificial Sequence: Synthetic oligonucleotide
  Target: AGXT; (+) strand; PAM type: YTN; PAM sequence: CTA
acagctgttgtattttgtca

SEQ ID NO: 18709 - DNA, 20 bp, Artificial Sequence
  Description of Artificial Sequence: Synthetic oligonucleotide
  Target: AGXT; (+) strand; PAM type: YTN; PAM sequence: CTG
ttgtattttgtcaaatacct

SEQ ID NO: 18710 - DNA, 20 bp, Artificial Sequence
  Description of Artificial Sequence: Synthetic oligonucleotide
  Target: AGXT; (+) strand; PAM type: YTN; PAM sequence: TTG
tattttgtcaaatacctttt

SEQ ID NO: 18711 - DNA, 20 bp, Artificial Sequence
  Description of Artificial Sequence: Synthetic oligonucleotide
  Target: AGXT; (+) strand; PAM type: YTN; PAM sequence: TTT
tgtcaaataccttttctgcc

SEQ ID NO: 18712 - DNA, 20 bp, Artificial Sequence
  Description of Artificial Sequence: Synthetic oligonucleotide
  Target: AGXT; (+) strand; PAM type: YTN; PAM sequence: TTT
gtcaaataccttttctgcct

SEQ ID NO: 18713 - DNA, 20 bp, Artificial Sequence
  Description of Artificial Sequence: Synthetic oligonucleotide
  Target: AGXT; (+) strand; PAM type: YTN; PAM sequence: TTG
tcaaataccttttctgccta

SEQ ID NO: 18714 - DNA, 20 bp, Artificial Sequence
  Description of Artificial Sequence: Synthetic oligonucleotide
  Target: AGXT; (+) strand; PAM type: YTN; PAM sequence: CTT
ttctgcctatggtgagatga

SEQ ID NO: 18715 - DNA, 20 bp, Artificial Sequence
  Description of Artificial Sequence: Synthetic oligonucleotide
  Target: AGXT; (+) strand; PAM type: YTN; PAM sequence: TTT
tctgcctatggtgagatgat

SEQ ID NO: 18716 - DNA, 20 bp, Artificial Sequence
  Description of Artificial Sequence: Synthetic oligonucleotide
  Target: AGXT; (+) strand; PAM type: YTN; PAM sequence: TTT
ctgcctatggtgagatgatc

SEQ ID NO: 18717 - DNA, 20 bp, Artificial Sequence
  Description of Artificial Sequence: Synthetic oligonucleotide
  Target: AGXT; (+) strand; PAM type: YTN; PAM sequence: TTC
tgcctatggtgagatgatca

SEQ ID NO: 18718 - DNA, 20 bp, Artificial Sequence
  Description of Artificial Sequence: Synthetic oligonucleotide
  Target: AGXT; (+) strand; PAM type: YTN; PAM sequence: CTG
cctatggtgagatgatcata

SEQ ID NO: 18719 - DNA, 20 bp, Artificial Sequence
  Description of Artificial Sequence: Synthetic oligonucleotide
  Target: AGXT; (+) strand; PAM type: YTN; PAM sequence: CTA
tggtgagatgatcataaagt

SEQ ID NO: 18720 - DNA, 20 bp, Artificial Sequence
  Description of Artificial Sequence: Synthetic oligonucleotide
  Target: AGXT; (+) strand; PAM type: YTN; PAM sequence: TTA
tgtttctatattctacggat

SEQ ID NO: 18721 - DNA, 20 bp, Artificial Sequence
  Description of Artificial Sequence: Synthetic oligonucleotide
  Target: AGXT; (+) strand; PAM type: YTN; PAM sequence: TTT
ctatattctacggatgtgct

SEQ ID NO: 18722 - DNA, 20 bp, Artificial Sequence
  Description of Artificial Sequence: Synthetic oligonucleotide
  Target: AGXT; (+) strand; PAM type: YTN; PAM sequence: TTC
tatattctacggatgtgctg

SEQ ID NO: 18723 - DNA, 20 bp, Artificial Sequence
  Description of Artificial Sequence: Synthetic oligonucleotide
  Target: AGXT; (+) strand; PAM type: YTN; PAM sequence: CTA
tattctacggatgtgctgtt

SEQ ID NO: 18724 - DNA, 20 bp, Artificial Sequence
  Description of Artificial Sequence: Synthetic oligonucleotide
  Target: AGXT; (+) strand; PAM type: YTN; PAM sequence: TTC
tacggatgtgctgttttgtt

SEQ ID NO: 18725 - DNA, 20 bp, Artificial Sequence
  Description of Artificial Sequence: Synthetic oligonucleotide
  Target: AGXT; (+) strand; PAM type: YTN; PAM sequence: CTA
cggatgtgctgttttgttga

SEQ ID NO: 18726 - DNA, 20 bp, Artificial Sequence
  Description of Artificial Sequence: Synthetic oligonucleotide
  Target: AGXT; (+) strand; PAM type: YTN; PAM sequence: CTG
ttttgttgactgacctctta

SEQ ID NO: 18727 - DNA, 20 bp, Artificial Sequence
  Description of Artificial Sequence: Synthetic oligonucleotide
  Target: AGXT; (+) strand; PAM type: YTN; PAM sequence: TTT
tgttgactgacctcttattt

SEQ ID NO: 18728 - DNA, 20 bp, Artificial Sequence
  Description of Artificial Sequence: Synthetic oligonucleotide
  Target: AGXT; (+) strand; PAM type: YTN; PAM sequence: TTT
gttgactgacctcttatttt

SEQ ID NO: 18729 - DNA, 20 bp, Artificial Sequence
  Description of Artificial Sequence: Synthetic oligonucleotide
  Target: AGXT; (+) strand; PAM type: YTN; PAM sequence: TTG
ttgactgacctcttattttc

SEQ ID NO: 18730 - DNA, 20 bp, Artificial Sequence
  Description of Artificial Sequence: Synthetic oligonucleotide
  Target: AGXT; (+) strand; PAM type: YTN; PAM sequence: TTG
actgacctcttattttctcg

SEQ ID NO: 18731 - DNA, 20 bp, Artificial Sequence
  Description of Artificial Sequence: Synthetic oligonucleotide
  Target: AGXT; (+) strand; PAM type: YTN; PAM sequence: CTG
acctcttattttctcgtaat

SEQ ID NO: 18732 - DNA, 20 bp, Artificial Sequence
  Description of Artificial Sequence: Synthetic oligonucleotide
  Target: AGXT; (+) strand; PAM type: YTN; PAM sequence: CTC
ttattttctcgtaatatatt

SEQ ID NO: 18733 - DNA, 20 bp, Artificial Sequence
  Description of Artificial Sequence: Synthetic oligonucleotide
  Target: AGXT; (+) strand; PAM type: YTN; PAM sequence: CTT
attttctcgtaatatatttg

SEQ ID NO: 18734 - DNA, 20 bp, Artificial Sequence
  Description of Artificial Sequence: Synthetic oligonucleotide
  Target: AGXT; (+) strand; PAM type: YTN; PAM sequence: TTA
ttttctcgtaatatatttgt

SEQ ID NO: 18735 - DNA, 20 bp, Artificial Sequence
  Description of Artificial Sequence: Synthetic oligonucleotide
  Target: AGXT; (+) strand; PAM type: YTN; PAM sequence: TTT
tctcgtaatatatttgtcag

SEQ ID NO: 18736 - DNA, 20 bp, Artificial Sequence
  Description of Artificial Sequence: Synthetic oligonucleotide
  Target: AGXT; (+) strand; PAM type: YTN; PAM sequence: TTT
ctcgtaatatatttgtcagg

SEQ ID NO: 18737 - DNA, 20 bp, Artificial Sequence
  Description of Artificial Sequence: Synthetic oligonucleotide
  Target: AGXT; (+) strand; PAM type: YTN; PAM sequence: TTC
tcgtaatatatttgtcaggt

SEQ ID NO: 18738 - DNA, 20 bp, Artificial Sequence
  Description of Artificial Sequence: Synthetic oligonucleotide
  Target: AGXT; (+) strand; PAM type: YTN; PAM sequence: CTC
gtaatatatttgtcaggttt

SEQ ID NO: 18739 - DNA, 20 bp, Artificial Sequence
  Description of Artificial Sequence: Synthetic oligonucleotide
  Target: AGXT; (+) strand; PAM type: YTN; PAM sequence: TTT
gtcaggttttgatagcaagg

SEQ ID NO: 18740 - DNA, 20 bp, Artificial Sequence
  Description of Artificial Sequence: Synthetic oligonucleotide
  Target: AGXT; (+) strand; PAM type: YTN; PAM sequence: TTG
tcaggttttgatagcaaggt

SEQ ID NO: 18741 - DNA, 20 bp, Artificial Sequence
  Description of Artificial Sequence: Synthetic oligonucleotide
  Target: AGXT; (+) strand; PAM type: YTN; PAM sequence: TTT
tgatagcaaggttacattgg

SEQ ID NO: 18742 - DNA, 20 bp, Artificial Sequence
  Description of Artificial Sequence: Synthetic oligonucleotide
  Target: AGXT; (+) strand; PAM type: YTN; PAM sequence: TTT
gatagcaaggttacattggt

SEQ ID NO: 18743 - DNA, 20 bp, Artificial Sequence
  Description of Artificial Sequence: Synthetic oligonucleotide
  Target: AGXT; (+) strand; PAM type: YTN; PAM sequence: TTG
atagcaaggttacattggtc

SEQ ID NO: 18744 - DNA, 20 bp, Artificial Sequence
  Description of Artificial Sequence: Synthetic oligonucleotide
  Target: AGXT; (+) strand; PAM type: YTN; PAM sequence: TTA
cattggtcttgtaaagtggt

SEQ ID NO: 18745 - DNA, 20 bp, Artificial Sequence
  Description of Artificial Sequence: Synthetic oligonucleotide
  Target: AGXT; (+) strand; PAM type: YTN; PAM sequence: TTG
gtcttgtaaagtggtttgga

SEQ ID NO: 18746 - DNA, 20 bp, Artificial Sequence
  Description of Artificial Sequence: Synthetic oligonucleotide
  Target: AGXT; (+) strand; PAM type: YTN; PAM sequence: CTT
gtaaagtggtttggacagta

SEQ ID NO: 18747 - DNA, 20 bp, Artificial Sequence
  Description of Artificial Sequence: Synthetic oligonucleotide
  Target: AGXT; (+) strand; PAM type: YTN; PAM sequence: TTG
taaagtggtttggacagtat

SEQ ID NO: 18748 - DNA, 20 bp, Artificial Sequence
  Description of Artificial Sequence: Synthetic oligonucleotide
  Target: AGXT; (+) strand; PAM type: YTN; PAM sequence: TTT
ggacagtattttcttttcct

SEQ ID NO: 18749 - DNA, 20 bp, Artificial Sequence
  Description of Artificial Sequence: Synthetic oligonucleotide
  Target: AGXT; (+) strand; PAM type: YTN; PAM sequence: TTG
gacagtattttcttttcctt

SEQ ID NO: 18750 - DNA, 20 bp, Artificial Sequence
  Description of Artificial Sequence: Synthetic oligonucleotide
  Target: AGXT; (+) strand; PAM type: YTN; PAM sequence: TTT
tcttttcctttatttatcaa

SEQ ID NO: 18751 - DNA, 20 bp, Artificial Sequence
  Description of Artificial Sequence: Synthetic oligonucleotide
  Target: AGXT; (+) strand; PAM type: YTN; PAM sequence: TTT
cttttcctttatttatcaat

SEQ ID NO: 18752 - DNA, 20 bp, Artificial Sequence
  Description of Artificial Sequence: Synthetic oligonucleotide
  Target: AGXT; (+) strand; PAM type: YTN; PAM sequence: TTC
ttttcctttatttatcaatt

SEQ ID NO: 18753 - DNA, 20 bp, Artificial Sequence
  Description of Artificial Sequence: Synthetic oligonucleotide
  Target: AGXT; (+) strand; PAM type: YTN; PAM sequence: CTT
ttcctttatttatcaattaa

SEQ ID NO: 18754 - DNA, 20 bp, Artificial Sequence
  Description of Artificial Sequence: Synthetic oligonucleotide
  Target: AGXT; (+) strand; PAM type: YTN; PAM sequence: TTT
tcctttatttatcaattaaa

SEQ ID NO: 18755 - DNA, 20 bp, Artificial Sequence
  Description of Artificial Sequence: Synthetic oligonucleotide
  Target: AGXT; (+) strand; PAM type: YTN; PAM sequence: TTT
cctttatttatcaattaaat

SEQ ID NO: 18756 - DNA, 20 bp, Artificial Sequence
  Description of Artificial Sequence: Synthetic oligonucleotide
  Target: AGXT; (+) strand; PAM type: YTN; PAM sequence: TTC
ctttatttatcaattaaatt

SEQ ID NO: 18757 - DNA, 20 bp, Artificial Sequence
  Description of Artificial Sequence: Synthetic oligonucleotide
  Target: AGXT; (+) strand; PAM type: YTN; PAM sequence: CTT
tatttatcaattaaatttgt

SEQ ID NO: 18758 - DNA, 20 bp, Artificial Sequence
  Description of Artificial Sequence: Synthetic oligonucleotide
  Target: AGXT; (+) strand; PAM type: YTN; PAM sequence: TTT
atttatcaattaaatttgtc

SEQ ID NO: 18759 - DNA, 20 bp, Artificial Sequence
  Description of Artificial Sequence: Synthetic oligonucleotide
  Target: AGXT; (+) strand; PAM type: YTN; PAM sequence: TTA
tttatcaattaaatttgtct

SEQ ID NO: 18760 - DNA, 20 bp, Artificial Sequence
  Description of Artificial Sequence: Synthetic oligonucleotide
  Target: AGXT; (+) strand; PAM type: YTN; PAM sequence: TTT
atcaattaaatttgtctaga

SEQ ID NO: 18761 - DNA, 20 bp, Artificial Sequence
  Description of Artificial Sequence: Synthetic oligonucleotide
  Target: AGXT; (+) strand; PAM type: YTN; PAM sequence: TTA
tcaattaaatttgtctagaa

SEQ ID NO: 18762 - DNA, 20 bp, Artificial Sequence
  Description of Artificial Sequence: Synthetic oligonucleotide
  Target: AGXT; (+) strand; PAM type: YTN; PAM sequence: TTA
aatttgtctagaatagggac

SEQ ID NO: 18763 - DNA, 20 bp, Artificial Sequence
  Description of Artificial Sequence: Synthetic oligonucleotide
  Target: AGXT; (+) strand; PAM type: YTN; PAM sequence: TTT
gtctagaatagggactattt

SEQ ID NO: 18764 - DNA, 20 bp, Artificial Sequence
  Description of Artificial Sequence: Synthetic oligonucleotide
  Target: AGXT; (+) strand; PAM type: YTN; PAM sequence: TTG
tctagaatagggactatttt

SEQ ID NO: 18765 - DNA, 20 bp, Artificial Sequence
  Description of Artificial Sequence: Synthetic oligonucleotide
  Target: AGXT; (+) strand; PAM type: YTN; PAM sequence: CTA
gaatagggactatttttttt

SEQ ID NO: 18766 - DNA, 20 bp, Artificial Sequence
  Description of Artificial Sequence: Synthetic oligonucleotide
  Target: AGXT; (+) strand; PAM type: YTN; PAM sequence: CTA
ttttttttttccttatattt

SEQ ID NO: 18767 - DNA, 20 bp, Artificial Sequence
  Description of Artificial Sequence: Synthetic oligonucleotide
  Target: AGXT; (+) strand; PAM type: YTN; PAM sequence: TTT
tttttttccttatattttgg

SEQ ID NO: 18768 - DNA, 20 bp, Artificial Sequence
  Description of Artificial Sequence: Synthetic oligonucleotide
  Target: AGXT; (+) strand; PAM type: YTN; PAM sequence: TTT
ttttttccttatattttggt

SEQ ID NO: 18769 - DNA, 20 bp, Artificial Sequence
  Description of Artificial Sequence: Synthetic oligonucleotide
  Target: AGXT; (+) strand; PAM type: YTN; PAM sequence: TTT
tttttccttatattttggta

SEQ ID NO: 18770 - DNA, 20 bp, Artificial Sequence
  Description of Artificial Sequence: Synthetic oligonucleotide
  Target: AGXT; (+) strand; PAM type: YTN; PAM sequence: TTT
ttttccttatattttggtag

SEQ ID NO: 18771 - DNA, 20 bp, Artificial Sequence
  Description of Artificial Sequence: Synthetic oligonucleotide
  Target: AGXT; (+) strand; PAM type: YTN; PAM sequence: TTT
tttccttatattttggtaga

SEQ ID NO: 18772 - DNA, 20 bp, Artificial Sequence
  Description of Artificial Sequence: Synthetic oligonucleotide
  Target: AGXT; (+) strand; PAM type: YTN; PAM sequence: TTT
ttccttatattttggtagaa

SEQ ID NO: 18773 - DNA, 20 bp, Artificial Sequence
  Description of Artificial Sequence: Synthetic oligonucleotide
  Target: AGXT; (+) strand; PAM type: YTN; PAM sequence: TTT
tccttatattttggtagaat

SEQ ID NO: 18774 - DNA, 20 bp, Artificial Sequence
  Description of Artificial Sequence: Synthetic oligonucleotide
  Target: AGXT; (+) strand; PAM type: YTN; PAM sequence: TTT
ccttatattttggtagaatt

SEQ ID NO: 18775 - DNA, 20 bp, Artificial Sequence
  Description of Artificial Sequence: Synthetic oligonucleotide
  Target: AGXT; (+) strand; PAM type: YTN; PAM sequence: TTC
cttatattttggtagaattg

SEQ ID NO: 18776 - DNA, 20 bp, Artificial Sequence
  Description of Artificial Sequence: Synthetic oligonucleotide
  Target: AGXT; (+) strand; PAM type: YTN; PAM sequence: CTT
atattttggtagaattgtcc

SEQ ID NO: 18777 - DNA, 20 bp, Artificial Sequence
  Description of Artificial Sequence: Synthetic oligonucleotide
  Target: AGXT; (+) strand; PAM type: YTN; PAM sequence: TTA
tattttggtagaattgtcca

SEQ ID NO: 18778 - DNA, 20 bp, Artificial Sequence
  Description of Artificial Sequence: Synthetic oligonucleotide
  Target: AGXT; (+) strand; PAM type: YTN; PAM sequence: TTT
tggtagaattgtccagtgaa

SEQ ID NO: 18779 - DNA, 20 bp, Artificial Sequence
  Description of Artificial Sequence: Synthetic oligonucleotide
  Target: AGXT; (+) strand; PAM type: YTN; PAM sequence: TTT
ggtagaattgtccagtgaag

SEQ ID NO: 18780 - DNA, 20 bp, Artificial Sequence
  Description of Artificial Sequence: Synthetic oligonucleotide
  Target: AGXT; (+) strand; PAM type: YTN; PAM sequence: TTG
gtagaattgtccagtgaagc

SEQ ID NO: 18781 - DNA, 20 bp, Artificial Sequence
  Description of Artificial Sequence: Synthetic oligonucleotide
  Target: AGXT; (+) strand; PAM type: YTN; PAM sequence: TTG
tccagtgaagctttatggga

SEQ ID NO: 18782 - DNA, 20 bp, Artificial Sequence
  Description of Artificial Sequence: Synthetic oligonucleotide
  Target: AGXT; (+) strand; PAM type: YTN; PAM sequence: CTT
tatgggacaggagctttctt

SEQ ID NO: 18783 - DNA, 20 bp, Artificial Sequence
  Description of Artificial Sequence: Synthetic oligonucleotide
  Target: AGXT; (+) strand; PAM type: YTN; PAM sequence: TTT
atgggacaggagctttcttt

SEQ ID NO: 18784 - DNA, 20 bp, Artificial Sequence
  Description of Artificial Sequence: Synthetic oligonucleotide
  Target: AGXT; (+) strand; PAM type: YTN; PAM sequence: TTA
tgggacaggagctttcttta

SEQ ID NO: 18785 - DNA, 20 bp, Artificial Sequence
  Description of Artificial Sequence: Synthetic oligonucleotide
  Target: AGXT; (+) strand; PAM type: YTN; PAM sequence: CTT
tctttatgggaaggattttt

SEQ ID NO: 18786 - DNA, 20 bp, Artificial Sequence
  Description of Artificial Sequence: Synthetic oligonucleotide
  Target: AGXT; (+) strand; PAM type: YTN; PAM sequence: TTT
ctttatgggaaggatttttt

SEQ ID NO: 18787 - DNA, 20 bp, Artificial Sequence
  Description of Artificial Sequence: Synthetic oligonucleotide
  Target: AGXT; (+) strand; PAM type: YTN; PAM sequence: TTC
tttatgggaaggattttttt

SEQ ID NO: 18788 - DNA, 20 bp, Artificial Sequence
  Description of Artificial Sequence: Synthetic oligonucleotide
  Target: AGXT; (+) strand; PAM type: YTN; PAM sequence: CTT
tatgggaaggatttttttaa

SEQ ID NO: 18789 - DNA, 20 bp, Artificial Sequence
  Description of Artificial Sequence: Synthetic oligonucleotide
  Target: AGXT; (+) strand; PAM type: YTN; PAM sequence: TTT
atgggaaggatttttttaat

SEQ ID NO: 18790 - DNA, 20 bp, Artificial Sequence
  Description of Artificial Sequence: Synthetic oligonucleotide
  Target: AGXT; (+) strand; PAM type: YTN; PAM sequence: TTA
tgggaaggatttttttaatg

SEQ ID NO: 18791 - DNA, 20 bp, Artificial Sequence
  Description of Artificial Sequence: Synthetic oligonucleotide
  Target: AGXT; (+) strand; PAM type: YTN; PAM sequence: TTT
ttttaatgacttctaatgtt

SEQ ID NO: 18792 - DNA, 20 bp, Artificial Sequence
  Description of Artificial Sequence: Synthetic oligonucleotide
  Target: AGXT; (+) strand; PAM type: YTN; PAM sequence: TTT
tttaatgacttctaatgttt

SEQ ID NO: 18793 - DNA, 20 bp, Artificial Sequence
  Description of Artificial Sequence: Synthetic oligonucleotide
  Target: AGXT; (+) strand; PAM type: YTN; PAM sequence: TTT
ttaatgacttctaatgtttt

SEQ ID NO: 18794 - DNA, 20 bp, Artificial Sequence
  Description of Artificial Sequence: Synthetic oligonucleotide
  Target: AGXT; (+) strand; PAM type: YTN; PAM sequence: TTT
taatgacttctaatgttttc

SEQ ID NO: 18795 - DNA, 20 bp, Artificial Sequence
  Description of Artificial Sequence: Synthetic oligonucleotide
  Target: AGXT; (+) strand; PAM type: YTN; PAM sequence: TTT
aatgacttctaatgttttca

SEQ ID NO: 18796 - DNA, 20 bp, Artificial Sequence
  Description of Artificial Sequence: Synthetic oligonucleotide
  Target: AGXT; (+) strand; PAM type: YTN; PAM sequence: TTA
atgacttctaatgttttcat

SEQ ID NO: 18797 - DNA, 20 bp, Artificial Sequence
  Description of Artificial Sequence: Synthetic oligonucleotide
  Target: AGXT; (+) strand; PAM type: YTN; PAM sequence: CTT
ctaatgttttcatagacata

SEQ ID NO: 18798 - DNA, 20 bp, Artificial Sequence
  Description of Artificial Sequence: Synthetic oligonucleotide
  Target: AGXT; (+) strand; PAM type: YTN; PAM sequence: TTC
taatgttttcatagacatag

SEQ ID NO: 18799 - DNA, 20 bp, Artificial Sequence
  Description of Artificial Sequence: Synthetic oligonucleotide
  Target: AGXT; (+) strand; PAM type: YTN; PAM sequence: CTA
atgttttcatagacatagag

SEQ ID NO: 18800 - DNA, 20 bp, Artificial Sequence
  Description of Artificial Sequence: Synthetic oligonucleotide
  Target: AGXT; (+) strand; PAM type: YTN; PAM sequence: TTT
tcatagacatagagttcttt

SEQ ID NO: 18801 - DNA, 20 bp, Artificial Sequence
  Description of Artificial Sequence: Synthetic oligonucleotide
  Target: AGXT; (+) strand; PAM type: YTN; PAM sequence: TTT
catagacatagagttcttta

SEQ ID NO: 18802 - DNA, 20 bp, Artificial Sequence
  Description of Artificial Sequence: Synthetic oligonucleotide
  Target: AGXT; (+) strand; PAM type: YTN; PAM sequence: TTC
atagacatagagttctttag

SEQ ID NO: 18803 - DNA, 20 bp, Artificial Sequence
  Description of Artificial Sequence: Synthetic oligonucleotide
  Target: AGXT; (+) strand; PAM type: YTN; PAM sequence: TTC
tttagatttttgtctctctc

SEQ ID NO: 18804 - DNA, 20 bp, Artificial Sequence
  Description of Artificial Sequence: Synthetic oligonucleotide
  Target: AGXT; (+) strand; PAM type: YTN; PAM sequence: CTT
tagatttttgtctctctctt

SEQ ID NO: 18805 - DNA, 20 bp, Artificial Sequence
  Description of Artificial Sequence: Synthetic oligonucleotide
  Target: AGXT; (+) strand; PAM type: YTN; PAM sequence: TTT
agatttttgtctctctcttt

SEQ ID NO: 18806 - DNA, 20 bp, Artificial Sequence
  Description of Artificial Sequence: Synthetic oligonucleotide
  Target: AGXT; (+) strand; PAM type: YTN; PAM sequence: TTA
gatttttgtctctctctttg

SEQ ID NO: 18807 - DNA, 20 bp, Artificial Sequence
  Description of Artificial Sequence: Synthetic oligonucleotide
  Target: AGXT; (+) strand; PAM type: YTN; PAM sequence: TTT
ttgtctctctctttgtgccc

SEQ ID NO: 18808 - DNA, 20 bp, Artificial Sequence
  Description of Artificial Sequence: Synthetic oligonucleotide
  Target: AGXT; (+) strand; PAM type: YTN; PAM sequence: TTT
tgtctctctctttgtgcccg

SEQ ID NO: 18809 - DNA, 20 bp, Artificial Sequence
  Description of Artificial Sequence: Synthetic oligonucleotide
  Target: AGXT; (+) strand; PAM type: YTN; PAM sequence: TTT
gtctctctctttgtgcccgt

SEQ ID NO: 18810 - DNA, 20 bp, Artificial Sequence
  Description of Artificial Sequence: Synthetic oligonucleotide
  Target: AGXT; (+) strand; PAM type: YTN; PAM sequence: TTG
tctctctctttgtgcccgtt

SEQ ID NO: 18811 - DNA, 20 bp, Artificial Sequence
  Description of Artificial Sequence: Synthetic oligonucleotide
  Target: AGXT; (+) strand; PAM type: YTN; PAM sequence: CTC
tctctttgtgcccgttttgg

SEQ ID NO: 18812 - DNA, 20 bp, Artificial Sequence
  Description of Artificial Sequence: Synthetic oligonucleotide
  Target: AGXT; (+) strand; PAM type: YTN; PAM sequence: CTC
tctttgtgcccgttttggta

SEQ ID NO: 18813 - DNA, 20 bp, Artificial Sequence
  Description of Artificial Sequence: Synthetic oligonucleotide
  Target: AGXT; (+) strand; PAM type: YTN; PAM sequence: CTC
tttgtgcccgttttggtaat

SEQ ID NO: 18814 - DNA, 20 bp, Artificial Sequence
  Description of Artificial Sequence: Synthetic oligonucleotide
  Target: AGXT; (+) strand; PAM type: YTN; PAM sequence: CTT
tgtgcccgttttggtaattt

SEQ ID NO: 18815 - DNA, 20 bp, Artificial Sequence
  Description of Artificial Sequence: Synthetic oligonucleotide
  Target: AGXT; (+) strand; PAM type: YTN; PAM sequence: TTT
gtgcccgttttggtaatttg

SEQ ID NO: 18816 - DNA, 20 bp, Artificial Sequence
  Description of Artificial Sequence: Synthetic oligonucleotide
  Target: AGXT; (+) strand; PAM type: YTN; PAM sequence: TTG
tgcccgttttggtaatttgt

SEQ ID NO: 18817 - DNA, 20 bp, Artificial Sequence
  Description of Artificial Sequence: Synthetic oligonucleotide
  Target: AGXT; (+) strand; PAM type: YTN; PAM sequence: TTT
tggtaatttgtgttacccag

SEQ ID NO: 18818 - DNA, 20 bp, Artificial Sequence
  Description of Artificial Sequence: Synthetic oligonucleotide
  Target: AGXT; (+) strand; PAM type: YTN; PAM sequence: TTT
ggtaatttgtgttacccaga

SEQ ID NO: 18819 - DNA, 20 bp, Artificial Sequence
  Description of Artificial Sequence: Synthetic oligonucleotide
  Target: AGXT; (+) strand; PAM type: YTN; PAM sequence: TTG
gtaatttgtgttacccagag

SEQ ID NO: 18820 - DNA, 20 bp, Artificial Sequence
  Description of Artificial Sequence: Synthetic oligonucleotide
  Target: AGXT; (+) strand; PAM type: YTN; PAM sequence: TTT
gtgttacccagagcatgctt

SEQ ID NO: 18821 - DNA, 20 bp, Artificial Sequence
  Description of Artificial Sequence: Synthetic oligonucleotide
  Target: AGXT; (+) strand; PAM type: YTN; PAM sequence: TTG
tgttacccagagcatgcttg

SEQ ID NO: 18822 - DNA, 20 bp, Artificial Sequence
  Description of Artificial Sequence: Synthetic oligonucleotide
  Target: AGXT; (+) strand; PAM type: YTN; PAM sequence: TTA
cccagagcatgcttgattcc

SEQ ID NO: 18823 - DNA, 20 bp, Artificial Sequence
  Description of Artificial Sequence: Synthetic oligonucleotide
  Target: AGXT; (+) strand; PAM type: YTN; PAM sequence: CTT
gattccaagttgttgaatgt

SEQ ID NO: 18824 - DNA, 20 bp, Artificial Sequence
  Description of Artificial Sequence: Synthetic oligonucleotide
  Target: AGXT; (+) strand; PAM type: YTN; PAM sequence: TTG
attccaagttgttgaatgtg

SEQ ID NO: 18825 - DNA, 20 bp, Artificial Sequence
  Description of Artificial Sequence: Synthetic oligonucleotide
  Target: AGXT; (+) strand; PAM type: YTN; PAM sequence: TTC
caagttgttgaatgtgttgg

SEQ ID NO: 18826 - DNA, 20 bp, Artificial Sequence
  Description of Artificial Sequence: Synthetic oligonucleotide
  Target: AGXT; (+) strand; PAM type: YTN; PAM sequence: TTG
ttgaatgtgttggcataaaa

SEQ ID NO: 18827 - DNA, 20 bp, Artificial Sequence
  Description of Artificial Sequence: Synthetic oligonucleotide
  Target: AGXT; (+) strand; PAM type: YTN; PAM sequence: TTG
aatgtgttggcataaaatca

SEQ ID NO: 18828 - DNA, 20 bp, Artificial Sequence
  Description of Artificial Sequence: Synthetic oligonucleotide
  Target: AGXT; (+) strand; PAM type: YTN; PAM sequence: TTG
gcataaaatcatccataata

SEQ ID NO: 18829 - DNA, 20 bp, Artificial Sequence
  Description of Artificial Sequence: Synthetic oligonucleotide
  Target: AGXT; (+) strand; PAM type: YTN; PAM sequence: CTT
tattatcctttaatgcttac

SEQ ID NO: 18830 - DNA, 20 bp, Artificial Sequence
  Description of Artificial Sequence: Synthetic oligonucleotide
  Target: AGXT; (+) strand; PAM type: YTN; PAM sequence: TTT
attatcctttaatgcttacg

SEQ ID NO: 18831 - DNA, 20 bp, Artificial Sequence
  Description of Artificial Sequence: Synthetic oligonucleotide
  Target: AGXT; (+) strand; PAM type: YTN; PAM sequence: TTA
ttatcctttaatgcttacgg

SEQ ID NO: 18832 - DNA, 20 bp, Artificial Sequence
  Description of Artificial Sequence: Synthetic oligonucleotide
  Target: AGXT; (+) strand; PAM type: YTN; PAM sequence: TTA
tcctttaatgcttacgggct

SEQ ID NO: 18833 - DNA, 20 bp, Artificial Sequence
  Description of Artificial Sequence: Synthetic oligonucleotide
  Target: AGXT; (+) strand; PAM type: YTN; PAM sequence: CTT
taatgcttacgggctctcta

SEQ ID NO: 18834 - DNA, 20 bp, Artificial Sequence
  Description of Artificial Sequence: Synthetic oligonucleotide
  Target: AGXT; (+) strand; PAM type: YTN; PAM sequence: TTT
aatgcttacgggctctctat

SEQ ID NO: 18835 - DNA, 20 bp, Artificial Sequence
  Description of Artificial Sequence: Synthetic oligonucleotide
  Target: AGXT; (+) strand; PAM type: YTN; PAM sequence: TTA
atgcttacgggctctctatt

SEQ ID NO: 18836 - DNA, 20 bp, Artificial Sequence
  Description of Artificial Sequence: Synthetic oligonucleotide
  Target: AGXT; (+) strand; PAM type: YTN; PAM sequence: CTT
acgggctctctattgatttc

SEQ ID NO: 18837 - DNA, 20 bp, Artificial Sequence
  Description of Artificial Sequence: Synthetic oligonucleotide
  Target: AGXT; (+) strand; PAM type: YTN; PAM sequence: TTA
cgggctctctattgatttcc

SEQ ID NO: 18838 - DNA, 20 bp, Artificial Sequence
  Description of Artificial Sequence: Synthetic oligonucleotide
  Target: AGXT; (+) strand; PAM type: YTN; PAM sequence: CTC
tctattgatttccctgtttc

SEQ ID NO: 18839 - DNA, 20 bp, Artificial Sequence
  Description of Artificial Sequence: Synthetic oligonucleotide
  Target: AGXT; (+) strand; PAM type: YTN; PAM sequence: CTC
tattgatttccctgtttcat

SEQ ID NO: 18840 - DNA, 20 bp, Artificial Sequence
  Description of Artificial Sequence: Synthetic oligonucleotide
  Target: AGXT; (+) strand; PAM type: YTN; PAM sequence: CTA
ttgatttccctgtttcattc

SEQ ID NO: 18841 - DNA, 20 bp, Artificial Sequence
  Description of Artificial Sequence: Synthetic oligonucleotide
  Target: AGXT; (+) strand; PAM type: YTN; PAM sequence: TTG
atttccctgtttcattcctg

SEQ ID NO: 18842 - DNA, 20 bp, Artificial Sequence
  Description of Artificial Sequence: Synthetic oligonucleotide
  Target: AGXT; (+) strand; PAM type: YTN; PAM sequence: TTT
ccctgtttcattcctggtat

SEQ ID NO: 18843 - DNA, 20 bp, Artificial Sequence
  Description of Artificial Sequence: Synthetic oligonucleotide
  Target: AGXT; (+) strand; PAM type: YTN; PAM sequence: TTC
cctgtttcattcctggtatt

SEQ ID NO: 18844 - DNA, 20 bp, Artificial Sequence
  Description of Artificial Sequence: Synthetic oligonucleotide
  Target: AGXT; (+) strand; PAM type: YTN; PAM sequence: CTG
tttcattcctggtattggta

SEQ ID NO: 18845 - DNA, 20 bp, Artificial Sequence
  Description of Artificial Sequence: Synthetic oligonucleotide
  Target: AGXT; (+) strand; PAM type: YTN; PAM sequence: TTT
cattcctggtattggtaatt

SEQ ID NO: 18846 - DNA, 20 bp, Artificial Sequence
  Description of Artificial Sequence: Synthetic oligonucleotide
  Target: AGXT; (+) strand; PAM type: YTN; PAM sequence: TTC
attcctggtattggtaattt

SEQ ID NO: 18847 - DNA, 20 bp, Artificial Sequence
  Description of Artificial Sequence: Synthetic oligonucleotide
  Target: AGXT; (+) strand; PAM type: YTN; PAM sequence: TTC
ctggtattggtaatttatat

SEQ ID NO: 18848 - DNA, 20 bp, Artificial Sequence
  Description of Artificial Sequence: Synthetic oligonucleotide
  Target: AGXT; (+) strand; PAM type: YTN; PAM sequence: CTG
gtattggtaatttatatttt

SEQ ID NO: 18849 - DNA, 20 bp, Artificial Sequence
  Description of Artificial Sequence: Synthetic oligonucleotide
  Target: AGXT; (+) strand; PAM type: YTN; PAM sequence: TTG
gtaatttatattttctcctt

SEQ ID NO: 18850 - DNA, 20 bp, Artificial Sequence
  Description of Artificial Sequence: Synthetic oligonucleotide
  Target: AGXT; (+) strand; PAM type: YTN; PAM sequence: TTT
atattttctccttttttttc

SEQ ID NO: 18851 - DNA, 20 bp, Artificial Sequence
  Description of Artificial Sequence: Synthetic oligonucleotide
  Target: AGXT; (+) strand; PAM type: YTN; PAM sequence: TTA
tattttctccttttttttct

SEQ ID NO: 18852 - DNA, 20 bp, Artificial Sequence
  Description of Artificial Sequence: Synthetic oligonucleotide
  Target: AGXT; (+) strand; PAM type: YTN; PAM sequence: TTT
tctccttttttttctcccat

SEQ ID NO: 18853 - DNA, 20 bp, Artificial Sequence
  Description of Artificial Sequence: Synthetic oligonucleotide
  Target: AGXT; (+) strand; PAM type: YTN; PAM sequence: TTT
ctccttttttttctcccatt

SEQ ID NO: 18854 - DNA, 20 bp, Artificial Sequence
  Description of Artificial Sequence: Synthetic oligonucleotide
  Target: AGXT; (+) strand; PAM type: YTN; PAM sequence: TTC
tccttttttttctcccattg

SEQ ID NO: 18855 - DNA, 20 bp, Artificial Sequence
  Description of Artificial Sequence: Synthetic oligonucleotide
  Target: AGXT; (+) strand; PAM type: YTN; PAM sequence: CTC
cttttttttctcccattgat

SEQ ID NO: 18856 - DNA, 20 bp, Artificial Sequence
  Description of Artificial Sequence: Synthetic oligonucleotide
  Target: AGXT; (+) strand; PAM type: YTN; PAM sequence: CTT
ttttttctcccattgatcag

SEQ ID NO: 18857 - DNA, 20 bp, Artificial Sequence
  Description of Artificial Sequence: Synthetic oligonucleotide
  Target: AGXT; (+) strand; PAM type: YTN; PAM sequence: TTT
tttttctcccattgatcagt

SEQ ID NO: 18858 - DNA, 20 bp, Artificial Sequence
  Description of Artificial Sequence: Synthetic oligonucleotide
  Target: AGXT; (+) strand; PAM type: YTN; PAM sequence: TTT
ttttctcccattgatcagtc

SEQ ID NO: 18859 - DNA, 20 bp, Artificial Sequence
  Description of Artificial Sequence: Synthetic oligonucleotide
  Target: AGXT; (+) strand; PAM type: YTN; PAM sequence: TTT
tttctcccattgatcagtct

SEQ ID NO: 18860 - DNA, 20 bp, Artificial Sequence
  Description of Artificial Sequence: Synthetic oligonucleotide
  Target: AGXT; (+) strand; PAM type: YTN; PAM sequence: TTT
ttctcccattgatcagtctt

SEQ ID NO: 18861 - DNA, 20 bp, Artificial Sequence
  Description of Artificial Sequence: Synthetic oligonucleotide
  Target: AGXT; (+) strand; PAM type: YTN; PAM sequence: TTT
tctcccattgatcagtcttg

SEQ ID NO: 18862 - DNA, 20 bp, Artificial Sequence
  Description of Artificial Sequence: Synthetic oligonucleotide
  Target: AGXT; (+) strand; PAM type: YTN; PAM sequence: TTT
ctcccattgatcagtcttgc

SEQ ID NO: 18863 - DNA, 20 bp, Artificial Sequence
  Description of Artificial Sequence: Synthetic oligonucleotide
  Target: AGXT; (+) strand; PAM type: YTN; PAM sequence: TTC
tcccattgatcagtcttgct

SEQ ID NO: 18864 - DNA, 20 bp, Artificial Sequence
  Description of Artificial Sequence: Synthetic oligonucleotide
  Target: AGXT; (+) strand; PAM type: YTN; PAM sequence: CTC
ccattgatcagtcttgctag

SEQ ID NO: 18865 - DNA, 20 bp, Artificial Sequence
  Description of Artificial Sequence: Synthetic oligonucleotide
  Target: AGXT; (+) strand; PAM type: YTN; PAM sequence: TTG
atcagtcttgctagggggtt

SEQ ID NO: 18866 - DNA, 20 bp, Artificial Sequence
  Description of Artificial Sequence: Synthetic oligonucleotide
  Target: AGXT; (+) strand; PAM type: YTN; PAM sequence: CTT
gctagggggttactgatttt

SEQ ID NO: 18867 - DNA, 20 bp, Artificial Sequence
  Description of Artificial Sequence: Synthetic oligonucleotide
  Target: AGXT; (+) strand; PAM type: YTN; PAM sequence: TTG
ctagggggttactgatttta

SEQ ID NO: 18868 - DNA, 20 bp, Artificial Sequence
  Description of Artificial Sequence: Synthetic oligonucleotide
  Target: AGXT; (+) strand; PAM type: YTN; PAM sequence: CTA
gggggttactgattttatta

SEQ ID NO: 18869 - DNA, 20 bp, Artificial Sequence
  Description of Artificial Sequence: Synthetic oligonucleotide
  Target: AGXT; (+) strand; PAM type: YTN; PAM sequence: TTA
ctgattttattagtctctcc

SEQ ID NO: 18870 - DNA, 20 bp, Artificial Sequence
  Description of Artificial Sequence: Synthetic oligonucleotide
  Target: AGXT; (+) strand; PAM type: YTN; PAM sequence: CTG
attttattagtctctccaaa

SEQ ID NO: 18871 - DNA, 20 bp, Artificial Sequence
  Description of Artificial Sequence: Synthetic oligonucleotide
  Target: AGXT; (+) strand; PAM type: YTN; PAM sequence: TTT
tattagtctctccaaaaaag

SEQ ID NO: 18872 - DNA, 20 bp, Artificial Sequence
  Description of Artificial Sequence: Synthetic oligonucleotide
  Target: AGXT; (+) strand; PAM type: YTN; PAM sequence: TTT
attagtctctccaaaaaagc

SEQ ID NO: 18873 - DNA, 20 bp, Artificial Sequence
  Description of Artificial Sequence: Synthetic oligonucleotide
  Target: AGXT; (+) strand; PAM type: YTN; PAM sequence: TTA
ttagtctctccaaaaaagcg

SEQ ID NO: 18874 - DNA, 20 bp, Artificial Sequence
  Description of Artificial Sequence: Synthetic oligonucleotide
  Target: AGXT; (+) strand; PAM type: YTN; PAM sequence: TTA
gtctctccaaaaaagcgaca

SEQ ID NO: 18875 - DNA, 20 bp, Artificial Sequence
  Description of Artificial Sequence: Synthetic oligonucleotide
  Target: AGXT; (+) strand; PAM type: YTN; PAM sequence: CTC
tccaaaaaagcgacatttac

SEQ ID NO: 18876 - DNA, 20 bp, Artificial Sequence
  Description of Artificial Sequence: Synthetic oligonucleotide
  Target: AGXT; (+) strand; PAM type: YTN; PAM sequence: CTC
caaaaaagcgacatttacca

SEQ ID NO: 18877 - DNA, 20 bp, Artificial Sequence
  Description of Artificial Sequence: Synthetic oligonucleotide
  Target: AGXT; (+) strand; PAM type: YTN; PAM sequence: TTT
accatcattttctcaattgt

SEQ ID NO: 18878 - DNA, 20 bp, Artificial Sequence
  Description of Artificial Sequence: Synthetic oligonucleotide
  Target: AGXT; (+) strand; PAM type: YTN; PAM sequence: TTA
ccatcattttctcaattgtt

SEQ ID NO: 18879 - DNA, 20 bp, Artificial Sequence
  Description of Artificial Sequence: Synthetic oligonucleotide
  Target: AGXT; (+) strand; PAM type: YTN; PAM sequence: TTT
tctcaattgtttgctttgta

SEQ ID NO: 18880 - DNA, 20 bp, Artificial Sequence
  Description of Artificial Sequence: Synthetic oligonucleotide
  Target: AGXT; (+) strand; PAM type: YTN; PAM sequence: TTT
ctcaattgtttgctttgtat

SEQ ID NO: 18881 - DNA, 20 bp, Artificial Sequence
  Description of Artificial Sequence: Synthetic oligonucleotide
  Target: AGXT; (+) strand; PAM type: YTN; PAM sequence: TTC
tcaattgtttgctttgtatt

SEQ ID NO: 18882 - DNA, 20 bp, Artificial Sequence
  Description of Artificial Sequence: Synthetic oligonucleotide
  Target: AGXT; (+) strand; PAM type: YTN; PAM sequence: CTC
aattgtttgctttgtattga

SEQ ID NO: 18883 - DNA, 20 bp, Artificial Sequence
  Description of Artificial Sequence: Synthetic oligonucleotide
  Target: AGXT; (+) strand; PAM type: YTN; PAM sequence: TTG
tttgctttgtattgatttcc

SEQ ID NO: 18884 - DNA, 20 bp, Artificial Sequence
  Description of Artificial Sequence: Synthetic oligonucleotide
  Target: AGXT; (+) strand; PAM type: YTN; PAM sequence: TTT
gctttgtattgatttccact

SEQ ID NO: 18885 - DNA, 20 bp, Artificial Sequence
  Description of Artificial Sequence: Synthetic oligonucleotide
  Target: AGXT; (+) strand; PAM type: YTN; PAM sequence: TTG
ctttgtattgatttccactc

SEQ ID NO: 18886 - DNA, 20 bp, Artificial Sequence
  Description of Artificial Sequence: Synthetic oligonucleotide
  Target: AGXT; (+) strand; PAM type: YTN; PAM sequence: CTT
tgtattgatttccactctta

SEQ ID NO: 18887 - DNA, 20 bp, Artificial Sequence
  Description of Artificial Sequence: Synthetic oligonucleotide
  Target: AGXT; (+) strand; PAM type: YTN; PAM sequence: TTT
gtattgatttccactcttat

SEQ ID NO: 18888 - DNA, 20 bp, Artificial Sequence
  Description of Artificial Sequence: Synthetic oligonucleotide
  Target: AGXT; (+) strand; PAM type: YTN; PAM sequence: TTG
tattgatttccactcttatt

SEQ ID NO: 18889 - DNA, 20 bp, Artificial Sequence
  Description of Artificial Sequence: Synthetic oligonucleotide
  Target: AGXT; (+) strand; PAM type: YTN; PAM sequence: TTG
atttccactcttattgttcc

SEQ ID NO: 18890 - DNA, 20 bp, Artificial Sequence
  Description of Artificial Sequence: Synthetic oligonucleotide
  Target: AGXT; (+) strand; PAM type: YTN; PAM sequence: TTT
ccactcttattgttcctttt

SEQ ID NO: 18891 - DNA, 20 bp, Artificial Sequence
  Description of Artificial Sequence: Synthetic oligonucleotide
  Target: AGXT; (+) strand; PAM type: YTN; PAM sequence: TTC
cactcttattgttcctttta

SEQ ID NO: 18892 - DNA, 20 bp, Artificial Sequence
  Description of Artificial Sequence: Synthetic oligonucleotide
  Target: AGXT; (+) strand; PAM type: YTN; PAM sequence: CTC
ttattgttccttttatttta

SEQ ID NO: 18893 - DNA, 20 bp, Artificial Sequence
  Description of Artificial Sequence: Synthetic oligonucleotide
  Target: AGXT; (+) strand; PAM type: YTN; PAM sequence: CTT
attgttccttttattttact

SEQ ID NO: 18894 - DNA, 20 bp, Artificial Sequence
  Description of Artificial Sequence: Synthetic oligonucleotide
  Target: AGXT; (+) strand; PAM type: YTN; PAM sequence: TTA
ttgttccttttattttactt

SEQ ID NO: 18895 - DNA, 20 bp, Artificial Sequence
  Description of Artificial Sequence: Synthetic oligonucleotide
  Target: AGXT; (+) strand; PAM type: YTN; PAM sequence: TTG
ttccttttattttacttcct

SEQ ID NO: 18896 - DNA, 20 bp, Artificial Sequence
  Description of Artificial Sequence: Synthetic oligonucleotide
  Target: AGXT; (+) strand; PAM type: YTN; PAM sequence: TTC
cttttattttacttcctttg

SEQ ID NO: 18897 - DNA, 20 bp, Artificial Sequence
  Description of Artificial Sequence: Synthetic oligonucleotide
  Target: AGXT; (+) strand; PAM type: YTN; PAM sequence: CTT
ttattttacttcctttggtt

SEQ ID NO: 18898 - DNA, 20 bp, Artificial Sequence
  Description of Artificial Sequence: Synthetic oligonucleotide
  Target: AGXT; (+) strand; PAM type: YTN; PAM sequence: TTT
tattttacttcctttggttt

SEQ ID NO: 18899 - DNA, 20 bp, Artificial Sequence
  Description of Artificial Sequence: Synthetic oligonucleotide
  Target: AGXT; (+) strand; PAM type: YTN; PAM sequence: TTT
attttacttcctttggtttt

SEQ ID NO: 18900 - DNA, 20 bp, Artificial Sequence
  Description of Artificial Sequence: Synthetic oligonucleotide
  Target: AGXT; (+) strand; PAM type: YTN; PAM sequence: TTA
ttttacttcctttggtttta

SEQ ID NO: 18901 - DNA, 20 bp, Artificial Sequence
  Description of Artificial Sequence: Synthetic oligonucleotide
  Target: AGXT; (+) strand; PAM type: YTN; PAM sequence: TTT
tacttcctttggttttaatt

SEQ ID NO: 18902 - DNA, 20 bp, Artificial Sequence
  Description of Artificial Sequence: Synthetic oligonucleotide
  Target: AGXT; (+) strand; PAM type: YTN; PAM sequence: TTT
acttcctttggttttaattt

SEQ ID NO: 18903 - DNA, 20 bp, Artificial Sequence
  Description of Artificial Sequence: Synthetic oligonucleotide
  Target: AGXT; (+) strand; PAM type: YTN; PAM sequence: TTA
cttcctttggttttaatttg

SEQ ID NO: 18904 - DNA, 20 bp, Artificial Sequence
  Description of Artificial Sequence: Synthetic oligonucleotide
  Target: AGXT; (+) strand; PAM type: YTN; PAM sequence: CTT
cctttggttttaatttgctc

SEQ ID NO: 18905 - DNA, 20 bp, Artificial Sequence
  Description of Artificial Sequence: Synthetic oligonucleotide
  Target: AGXT; (+) strand; PAM type: YTN; PAM sequence: TTC
ctttggttttaatttgctcc

SEQ ID NO: 18906 - DNA, 20 bp, Artificial Sequence
  Description of Artificial Sequence: Synthetic oligonucleotide
  Target: AGXT; (+) strand; PAM type: YTN; PAM sequence: CTT
tggttttaatttgctcctct

SEQ ID NO: 18907 - DNA, 20 bp, Artificial Sequence
  Description of Artificial Sequence: Synthetic oligonucleotide
  Target: AGXT; (+) strand; PAM type: YTN; PAM sequence: TTT
ggttttaatttgctcctctt

SEQ ID NO: 18908 - DNA, 20 bp, Artificial Sequence
  Description of Artificial Sequence: Synthetic oligonucleotide
  Target: AGXT; (+) strand; PAM type: YTN; PAM sequence: TTG
gttttaatttgctcctcttt

SEQ ID NO: 18909 - DNA, 20 bp, Artificial Sequence
  Description of Artificial Sequence: Synthetic oligonucleotide
  Target: AGXT; (+) strand; PAM type: YTN; PAM sequence: TTT
taatttgctcctctttttct

SEQ ID NO: 18910 - DNA, 20 bp, Artificial Sequence
  Description of Artificial Sequence: Synthetic oligonucleotide
  Target: AGXT; (+) strand; PAM type: YTN; PAM sequence: TTT
aatttgctcctctttttcta

SEQ ID NO: 18911 - DNA, 20 bp, Artificial Sequence
  Description of Artificial Sequence: Synthetic oligonucleotide
  Target: AGXT; (+) strand; PAM type: YTN; PAM sequence: TTA
atttgctcctctttttctag

SEQ ID NO: 18912 - DNA, 20 bp, Artificial Sequence
  Description of Artificial Sequence: Synthetic oligonucleotide
  Target: AGXT; (+) strand; PAM type: YTN; PAM sequence: TTT
gctcctctttttctagcttc

SEQ ID NO: 18913 - DNA, 20 bp, Artificial Sequence
  Description of Artificial Sequence: Synthetic oligonucleotide
  Target: AGXT; (+) strand; PAM type: YTN; PAM sequence: TTG
ctcctctttttctagcttcc

SEQ ID NO: 18914 - DNA, 20 bp, Artificial Sequence
  Description of Artificial Sequence: Synthetic oligonucleotide
  Target: AGXT; (+) strand; PAM type: YTN; PAM sequence: CTC
ctctttttctagcttcctat

SEQ ID NO: 18915 - DNA, 20 bp, Artificial Sequence
  Description of Artificial Sequence: Synthetic oligonucleotide
  Target: AGXT; (+) strand; PAM type: YTN; PAM sequence: CTC
tttttctagcttcctatggt

SEQ ID NO: 18916 - DNA, 20 bp, Artificial Sequence
  Description of Artificial Sequence: Synthetic oligonucleotide
  Target: AGXT; (+) strand; PAM type: YTN; PAM sequence: CTT
tttctagcttcctatggtag

SEQ ID NO: 18917 - DNA, 20 bp, Artificial Sequence
  Description of Artificial Sequence: Synthetic oligonucleotide
  Target: AGXT; (+) strand; PAM type: YTN; PAM sequence: TTT
ttctagcttcctatggtaga

SEQ ID NO: 18918 - DNA, 20 bp, Artificial Sequence
  Description of Artificial Sequence: Synthetic oligonucleotide
  Target: AGXT; (+) strand; PAM type: YTN; PAM sequence: TTT
tctagcttcctatggtagaa

SEQ ID NO: 18919 - DNA, 20 bp, Artificial Sequence
  Description of Artificial Sequence: Synthetic oligonucleotide
  Target: AGXT; (+) strand; PAM type: YTN; PAM sequence: TTT
ctagcttcctatggtagaag

SEQ ID NO: 18920 - DNA, 20 bp, Artificial Sequence
  Description of Artificial Sequence: Synthetic oligonucleotide
  Target: AGXT; (+) strand; PAM type: YTN; PAM sequence: TTC
tagcttcctatggtagaagc

SEQ ID NO: 18921 - DNA, 20 bp, Artificial Sequence
  Description of Artificial Sequence: Synthetic oligonucleotide
  Target: AGXT; (+) strand; PAM type: YTN; PAM sequence: CTA
gcttcctatggtagaagctt

SEQ ID NO: 18922 - DNA, 20 bp, Artificial Sequence
  Description of Artificial Sequence: Synthetic oligonucleotide
  Target: AGXT; (+) strand; PAM type: YTN; PAM sequence: CTT
cctatggtagaagcttaatt

SEQ ID NO: 18923 - DNA, 20 bp, Artificial Sequence
  Description of Artificial Sequence: Synthetic oligonucleotide
  Target: AGXT; (+) strand; PAM type: YTN; PAM sequence: TTC
ctatggtagaagcttaattg

SEQ ID NO: 18924 - DNA, 20 bp, Artificial Sequence
  Description of Artificial Sequence: Synthetic oligonucleotide
  Target: AGXT; (+) strand; PAM type: YTN; PAM sequence: CTA
tggtagaagcttaattgatt

SEQ ID NO: 18925 - DNA, 20 bp, Artificial Sequence
  Description of Artificial Sequence: Synthetic oligonucleotide
  Target: AGXT; (+) strand; PAM type: YTN; PAM sequence: CTT
aattgattttaaacatttat

SEQ ID NO: 18926 - DNA, 20 bp, Artificial Sequence
  Description of Artificial Sequence: Synthetic oligonucleotide
  Target: AGXT; (+) strand; PAM type: YTN; PAM sequence: TTA
attgattttaaacatttatt

SEQ ID NO: 18927 - DNA, 20 bp, Artificial Sequence
  Description of Artificial Sequence: Synthetic oligonucleotide
  Target: AGXT; (+) strand; PAM type: YTN; PAM sequence: TTG
attttaaacatttatttgtt

SEQ ID NO: 18928 - DNA, 20 bp, Artificial Sequence
  Description of Artificial Sequence: Synthetic oligonucleotide
  Target: AGXT; (+) strand; PAM type: YTN; PAM sequence: TTT
taaacatttatttgttttct

SEQ ID NO: 18929 - DNA, 20 bp, Artificial Sequence
  Description of Artificial Sequence: Synthetic oligonucleotide
  Target: AGXT; (+) strand; PAM type: YTN; PAM sequence: TTT
aaacatttatttgttttcta

SEQ ID NO: 18930 - DNA, 20 bp, Artificial Sequence
  Description of Artificial Sequence: Synthetic oligonucleotide
  Target: AGXT; (+) strand; PAM type: YTN; PAM sequence: TTA
aacatttatttgttttctag

SEQ ID NO: 18931 - DNA, 20 bp, Artificial Sequence
  Description of Artificial Sequence: Synthetic oligonucleotide
  Target: AGXT; (+) strand; PAM type: YTN; PAM sequence: TTT
atttgttttctagtatgagc

SEQ ID NO: 18932 - DNA, 20 bp, Artificial Sequence
  Description of Artificial Sequence: Synthetic oligonucleotide
  Target: AGXT; (+) strand; PAM type: YTN; PAM sequence: TTA
tttgttttctagtatgagca

SEQ ID NO: 18933 - DNA, 20 bp, Artificial Sequence
  Description of Artificial Sequence: Synthetic oligonucleotide
  Target: AGXT; (+) strand; PAM type: YTN; PAM sequence: TTT
gttttctagtatgagcattt

SEQ ID NO: 18934 - DNA, 20 bp, Artificial Sequence
  Description of Artificial Sequence: Synthetic oligonucleotide
  Target: AGXT; (+) strand; PAM type: YTN; PAM sequence: TTG
ttttctagtatgagcattta

SEQ ID NO: 18935 - DNA, 20 bp, Artificial Sequence
  Description of Artificial Sequence: Synthetic oligonucleotide
  Target: AGXT; (+) strand; PAM type: YTN; PAM sequence: TTT
tctagtatgagcatttaaag

SEQ ID NO: 18936 - DNA, 20 bp, Artificial Sequence
  Description of Artificial Sequence: Synthetic oligonucleotide
  Target: AGXT; (+) strand; PAM type: YTN; PAM sequence: TTT
ctagtatgagcatttaaagc

SEQ ID NO: 18937 - DNA, 20 bp, Artificial Sequence
  Description of Artificial Sequence: Synthetic oligonucleotide
  Target: AGXT; (+) strand; PAM type: YTN; PAM sequence: TTC
tagtatgagcatttaaagct

SEQ ID NO: 18938 - DNA, 20 bp, Artificial Sequence
  Description of Artificial Sequence: Synthetic oligonucleotide
  Target: AGXT; (+) strand; PAM type: YTN; PAM sequence: CTA
gtatgagcatttaaagctaa

SEQ ID NO: 18939 - DNA, 20 bp, Artificial Sequence
  Description of Artificial Sequence: Synthetic oligonucleotide
  Target: AGXT; (+) strand; PAM type: YTN; PAM sequence: TTT
aaagctaaacatttccctct

SEQ ID NO: 18940 - DNA, 20 bp, Artificial Sequence
  Description of Artificial Sequence: Synthetic oligonucleotide
  Target: AGXT; (+) strand; PAM type: YTN; PAM sequence: TTA
aagctaaacatttccctctg

SEQ ID NO: 18941 - DNA, 20 bp, Artificial Sequence
  Description of Artificial Sequence: Synthetic oligonucleotide
  Target: AGXT; (+) strand; PAM type: YTN; PAM sequence: CTA
aacatttccctctgagcgcc

SEQ ID NO: 18942 - DNA, 20 bp, Artificial Sequence
  Description of Artificial Sequence: Synthetic oligonucleotide
  Target: AGXT; (+) strand; PAM type: YTN; PAM sequence: TTT
ccctctgagcgccttcttca

SEQ ID NO: 18943 - DNA, 20 bp, Artificial Sequence
  Description of Artificial Sequence: Synthetic oligonucleotide
  Target: AGXT; (+) strand; PAM type: YTN; PAM sequence: TTC
cctctgagcgccttcttcac

SEQ ID NO: 18944 - DNA, 20 bp, Artificial Sequence
  Description of Artificial Sequence: Synthetic oligonucleotide
  Target: AGXT; (+) strand; PAM type: YTN; PAM sequence: CTC
tgagcgccttcttcactgca

SEQ ID NO: 18945 - DNA, 20 bp, Artificial Sequence
  Description of Artificial Sequence: Synthetic oligonucleotide
  Target: AGXT; (+) strand; PAM type: YTN; PAM sequence: CTG
agcgccttcttcactgcatc

SEQ ID NO: 18946 - DNA, 20 bp, Artificial Sequence
  Description of Artificial Sequence: Synthetic oligonucleotide
  Target: AGXT; (+) strand; PAM type: YTN; PAM sequence: CTT
cttcactgcatctcccaaat

SEQ ID NO: 18947 - DNA, 20 bp, Artificial Sequence
  Description of Artificial Sequence: Synthetic oligonucleotide
  Target: AGXT; (+) strand; PAM type: YTN; PAM sequence: TTC
ttcactgcatctcccaaatt

SEQ ID NO: 18948 - DNA, 20 bp, Artificial Sequence
  Description of Artificial Sequence: Synthetic oligonucleotide
  Target: AGXT; (+) strand; PAM type: YTN; PAM sequence: CTT
cactgcatctcccaaatttt

SEQ ID NO: 18949 - DNA, 20 bp, Artificial Sequence
  Description of Artificial Sequence: Synthetic oligonucleotide
  Target: AGXT; (+) strand; PAM type: YTN; PAM sequence: TTC
actgcatctcccaaatttta

SEQ ID NO: 18950 - DNA, 20 bp, Artificial Sequence
  Description of Artificial Sequence: Synthetic oligonucleotide
  Target: AGXT; (+) strand; PAM type: YTN; PAM sequence: CTG
catctcccaaattttaatca

SEQ ID NO: 18951 - DNA, 20 bp, Artificial Sequence
  Description of Artificial Sequence: Synthetic oligonucleotide
  Target: AGXT; (+) strand; PAM type: YTN; PAM sequence: CTC
ccaaattttaatcaatggtg

SEQ ID NO: 18952 - DNA, 20 bp, Artificial Sequence
  Description of Artificial Sequence: Synthetic oligonucleotide
  Target: AGXT; (+) strand; PAM type: YTN; PAM sequence: TTT
taatcaatggtgtttttgga

SEQ ID NO: 18953 - DNA, 20 bp, Artificial Sequence
  Description of Artificial Sequence: Synthetic oligonucleotide
  Target: AGXT; (+) strand; PAM type: YTN; PAM sequence: TTT
aatcaatggtgtttttggaa

SEQ ID NO: 18954 - DNA, 20 bp, Artificial Sequence
  Description of Artificial Sequence: Synthetic oligonucleotide
  Target: AGXT; (+) strand; PAM type: YTN; PAM sequence: TTA
atcaatggtgtttttggaat

SEQ ID NO: 18955 - DNA, 20 bp, Artificial Sequence
  Description of Artificial Sequence: Synthetic oligonucleotide
  Target: AGXT; (+) strand; PAM type: YTN; PAM sequence: TTT
ttggaatcactcagatcaaa

SEQ ID NO: 18956 - DNA, 20 bp, Artificial Sequence
  Description of Artificial Sequence: Synthetic oligonucleotide
  Target: AGXT; (+) strand; PAM type: YTN; PAM sequence: TTT
tggaatcactcagatcaaaa

SEQ ID NO: 18957 - DNA, 20 bp, Artificial Sequence
  Description of Artificial Sequence: Synthetic oligonucleotide
  Target: AGXT; (+) strand; PAM type: YTN; PAM sequence: TTT
ggaatcactcagatcaaaat

SEQ ID NO: 18958 - DNA, 20 bp, Artificial Sequence
  Description of Artificial Sequence: Synthetic oligonucleotide
  Target: AGXT; (+) strand; PAM type: YTN; PAM sequence: TTG
gaatcactcagatcaaaata

SEQ ID NO: 18959 - DNA, 20 bp, Artificial Sequence
  Description of Artificial Sequence: Synthetic oligonucleotide
  Target: AGXT; (+) strand; PAM type: YTN; PAM sequence: CTC
agatcaaaatattttataat

SEQ ID NO: 18960 - DNA, 20 bp, Artificial Sequence
  Description of Artificial Sequence: Synthetic oligonucleotide
  Target: AGXT; (+) strand; PAM type: YTN; PAM sequence: TTT
tataatttccttgtgattta

SEQ ID NO: 18961 - DNA, 20 bp, Artificial Sequence
  Description of Artificial Sequence: Synthetic oligonucleotide
  Target: AGXT; (+) strand; PAM type: YTN; PAM sequence: TTT
ataatttccttgtgatttat

SEQ ID NO: 18962 - DNA, 20 bp, Artificial Sequence
  Description of Artificial Sequence: Synthetic oligonucleotide
  Target: AGXT; (+) strand; PAM type: YTN; PAM sequence: TTA
taatttccttgtgatttatt

SEQ ID NO: 18963 - DNA, 20 bp, Artificial Sequence
  Description of Artificial Sequence: Synthetic oligonucleotide
  Target: AGXT; (+) strand; PAM type: YTN; PAM sequence: TTT
ccttgtgatttattctttga

SEQ ID NO: 18964 - DNA, 20 bp, Artificial Sequence
  Description of Artificial Sequence: Synthetic oligonucleotide
  Target: AGXT; (+) strand; PAM type: YTN; PAM sequence: TTC
cttgtgatttattctttgaa

SEQ ID NO: 18965 - DNA, 20 bp, Artificial Sequence
  Description of Artificial Sequence: Synthetic oligonucleotide
  Target: AGXT; (+) strand; PAM type: YTN; PAM sequence: CTT
gtgatttattctttgaacca

SEQ ID NO: 18966 - DNA, 20 bp, Artificial Sequence
  Description of Artificial Sequence: Synthetic oligonucleotide
  Target: AGXT; (+) strand; PAM type: YTN; PAM sequence: TTG
tgatttattctttgaaccac

SEQ ID NO: 18967 - DNA, 20 bp, Artificial Sequence
  Description of Artificial Sequence: Synthetic oligonucleotide
  Target: AGXT; (+) strand; PAM type: YTN; PAM sequence: TTT
attctttgaaccacagacta

SEQ ID NO: 18968 - DNA, 20 bp, Artificial Sequence
  Description of Artificial Sequence: Synthetic oligonucleotide
  Target: AGXT; (+) strand; PAM type: YTN; PAM sequence: TTA
ttctttgaaccacagactat

SEQ ID NO: 18969 - DNA, 20 bp, Artificial Sequence
  Description of Artificial Sequence: Synthetic oligonucleotide
  Target: AGXT; (+) strand; PAM type: YTN; PAM sequence: TTC
tttgaaccacagactattta

SEQ ID NO: 18970 - DNA, 20 bp, Artificial Sequence
  Description of Artificial Sequence: Synthetic oligonucleotide
  Target: AGXT; (+) strand; PAM type: YTN; PAM sequence: CTT
tgaaccacagactatttaga

SEQ ID NO: 18971 - DNA, 20 bp, Artificial Sequence
  Description of Artificial Sequence: Synthetic oligonucleotide
  Target: AGXT; (+) strand; PAM type: YTN; PAM sequence: TTT
gaaccacagactatttagac

SEQ ID NO: 18972 - DNA, 20 bp, Artificial Sequence
  Description of Artificial Sequence: Synthetic oligonucleotide
  Target: AGXT; (+) strand; PAM type: YTN; PAM sequence: TTG
aaccacagactatttagact

SEQ ID NO: 18973 - DNA, 20 bp, Artificial Sequence
  Description of Artificial Sequence: Synthetic oligonucleotide
  Target: AGXT; (+) strand; PAM type: YTN; PAM sequence: CTA
tttagacttatactgtgtaa

SEQ ID NO: 18974 - DNA, 20 bp, Artificial Sequence
  Description of Artificial Sequence: Synthetic oligonucleotide
  Target: AGXT; (+) strand; PAM type: YTN; PAM sequence: TTT
agacttatactgtgtaatgt

SEQ ID NO: 18975 - DNA, 20 bp, Artificial Sequence
  Description of Artificial Sequence: Synthetic oligonucleotide
  Target: AGXT; (+) strand; PAM type: YTN; PAM sequence: TTA
gacttatactgtgtaatgtt

SEQ ID NO: 18976 - DNA, 20 bp, Artificial Sequence
  Description of Artificial Sequence: Synthetic oligonucleotide
  Target: AGXT; (+) strand; PAM type: YTN; PAM sequence: CTT
atactgtgtaatgttcagat

SEQ ID NO: 18977 - DNA, 20 bp, Artificial Sequence
  Description of Artificial Sequence: Synthetic oligonucleotide
  Target: AGXT; (+) strand; PAM type: YTN; PAM sequence: TTA
tactgtgtaatgttcagata

SEQ ID NO: 18978 - DNA, 20 bp, Artificial Sequence
  Description of Artificial Sequence: Synthetic oligonucleotide
  Target: AGXT; (+) strand; PAM type: YTN; PAM sequence: CTG
tgtaatgttcagatatttgg

SEQ ID NO: 18979 - DNA, 20 bp, Artificial Sequence
  Description of Artificial Sequence: Synthetic oligonucleotide
  Target: AGXT; (+) strand; PAM type: YTN; PAM sequence: TTC
agatatttggtggatattct

SEQ ID NO: 18980 - DNA, 20 bp, Artificial Sequence
  Description of Artificial Sequence: Synthetic oligonucleotide
  Target: AGXT; (+) strand; PAM type: YTN; PAM sequence: TTT
ggtggatattctaaatgtat

SEQ ID NO: 18981 - DNA, 20 bp, Artificial Sequence
  Description of Artificial Sequence: Synthetic oligonucleotide
  Target: AGXT; (+) strand; PAM type: YTN; PAM sequence: TTG
gtggatattctaaatgtatt

SEQ ID NO: 18982 - DNA, 20 bp, Artificial Sequence
  Description of Artificial Sequence: Synthetic oligonucleotide
  Target: AGXT; (+) strand; PAM type: YTN; PAM sequence: TTC
taaatgtatttttgtttttt

SEQ ID NO: 18983 - DNA, 20 bp, Artificial Sequence
  Description of Artificial Sequence: Synthetic oligonucleotide
  Target: AGXT; (+) strand; PAM type: YTN; PAM sequence: CTA
aatgtatttttgttttttat

SEQ ID NO: 18984 - DNA, 20 bp, Artificial Sequence
  Description of Artificial Sequence: Synthetic oligonucleotide
  Target: AGXT; (+) strand; PAM type: YTN; PAM sequence: TTT
ttgttttttatttcaaattt

SEQ ID NO: 18985 - DNA, 20 bp, Artificial Sequence
  Description of Artificial Sequence: Synthetic oligonucleotide
  Target: AGXT; (+) strand; PAM type: YTN; PAM sequence: TTT
tgttttttatttcaaattta

SEQ ID NO: 18986 - DNA, 20 bp, Artificial Sequence
  Description of Artificial Sequence: Synthetic oligonucleotide
  Target: AGXT; (+) strand; PAM type: YTN; PAM sequence: TTT
gttttttatttcaaatttat

SEQ ID NO: 18987 - DNA, 20 bp, Artificial Sequence
  Description of Artificial Sequence: Synthetic oligonucleotide
  Target: AGXT; (+) strand; PAM type: YTN; PAM sequence: TTG
ttttttatttcaaatttatg

SEQ ID NO: 18988 - DNA, 20 bp, Artificial Sequence
  Description of Artificial Sequence: Synthetic oligonucleotide
  Target: AGXT; (+) strand; PAM type: YTN; PAM sequence: TTT
tttatttcaaatttatgtct

SEQ ID NO: 18989 - DNA, 20 bp, Artificial Sequence
  Description of Artificial Sequence: Synthetic oligonucleotide
  Target: AGXT; (+) strand; PAM type: YTN; PAM sequence: TTT
ttatttcaaatttatgtctg

SEQ ID NO: 18990 - DNA, 20 bp, Artificial Sequence
  Description of Artificial Sequence: Synthetic oligonucleotide
  Target: AGXT; (+) strand; PAM type: YTN; PAM sequence: TTT
tatttcaaatttatgtctgt

SEQ ID NO: 18991 - DNA, 20 bp, Artificial Sequence
  Description of Artificial Sequence: Synthetic oligonucleotide
  Target: AGXT; (+) strand; PAM type: YTN; PAM sequence: TTT
atttcaaatttatgtctgtt

SEQ ID NO: 18992 - DNA, 20 bp, Artificial Sequence
  Description of Artificial Sequence: Synthetic oligonucleotide
  Target: AGXT; (+) strand; PAM type: YTN; PAM sequence: TTA
tttcaaatttatgtctgttg

SEQ ID NO: 18993 - DNA, 20 bp, Artificial Sequence
  Description of Artificial Sequence: Synthetic oligonucleotide
  Target: AGXT; (+) strand; PAM type: YTN; PAM sequence: TTT
caaatttatgtctgttgtgg

SEQ ID NO: 18994 - DNA, 20 bp, Artificial Sequence
  Description of Artificial Sequence: Synthetic oligonucleotide
  Target: AGXT; (+) strand; PAM type: YTN; PAM sequence: TTC
aaatttatgtctgttgtggt

SEQ ID NO: 18995 - DNA, 20 bp, Artificial Sequence
  Description of Artificial Sequence: Synthetic oligonucleotide
  Target: AGXT; (+) strand; PAM type: YTN; PAM sequence: TTT
atgtctgttgtggtcagagc

SEQ ID NO: 18996 - DNA, 20 bp, Artificial Sequence
  Description of Artificial Sequence: Synthetic oligonucleotide
  Target: AGXT; (+) strand; PAM type: YTN; PAM sequence: TTA
tgtctgttgtggtcagagct

SEQ ID NO: 18997 - DNA, 20 bp, Artificial Sequence
  Description of Artificial Sequence: Synthetic oligonucleotide
  Target: AGXT; (+) strand; PAM type: YTN; PAM sequence: CTG
ttgtggtcagagctcatact

SEQ ID NO: 18998 - DNA, 20 bp, Artificial Sequence
  Description of Artificial Sequence: Synthetic oligonucleotide
  Target: AGXT; (+) strand; PAM type: YTN; PAM sequence: TTG
tggtcagagctcatactgta

SEQ ID NO: 18999 - DNA, 20 bp, Artificial Sequence
  Description of Artificial Sequence: Synthetic oligonucleotide
  Target: AGXT; (+) strand; PAM type: YTN; PAM sequence: CTC
atactgtatatggacttcag

SEQ ID NO: 19000 - DNA, 20 bp, Artificial Sequence
  Description of Artificial Sequence: Synthetic oligonucleotide
  Target: AGXT; (+) strand; PAM type: YTN; PAM sequence: CTG
tatatggacttcagtatttt

SEQ ID NO: 19001 - DNA, 20 bp, Artificial Sequence
  Description of Artificial Sequence: Synthetic oligonucleotide
  Target: AGXT; (+) strand; PAM type: YTN; PAM sequence: CTT
cagtattttgaacatgtact

SEQ ID NO: 19002 - DNA, 20 bp, Artificial Sequence
  Description of Artificial Sequence: Synthetic oligonucleotide
  Target: AGXT; (+) strand; PAM type: YTN; PAM sequence: TTC
agtattttgaacatgtactg

SEQ ID NO: 19003 - DNA, 20 bp, Artificial Sequence
  Description of Artificial Sequence: Synthetic oligonucleotide
  Target: AGXT; (+) strand; PAM type: YTN; PAM sequence: TTT
tgaacatgtactgagagtct

SEQ ID NO: 19004 - DNA, 20 bp, Artificial Sequence
  Description of Artificial Sequence: Synthetic oligonucleotide
  Target: AGXT; (+) strand; PAM type: YTN; PAM sequence: TTT
gaacatgtactgagagtctg

SEQ ID NO: 19005 - DNA, 20 bp, Artificial Sequence
  Description of Artificial Sequence: Synthetic oligonucleotide
  Target: AGXT; (+) strand; PAM type: YTN; PAM sequence: TTG
aacatgtactgagagtctgt

SEQ ID NO: 19006 - DNA, 20 bp, Artificial Sequence
  Description of Artificial Sequence: Synthetic oligonucleotide
  Target: AGXT; (+) strand; PAM type: YTN; PAM sequence: CTG
agagtctgttttataaacta

SEQ ID NO: 19007 - DNA, 20 bp, Artificial Sequence
  Description of Artificial Sequence: Synthetic oligonucleotide
  Target: AGXT; (+) strand; PAM type: YTN; PAM sequence: CTG
ttttataaactagcagcagt

SEQ ID NO: 19008 - DNA, 20 bp, Artificial Sequence
  Description of Artificial Sequence: Synthetic oligonucleotide
  Target: AGXT; (+) strand; PAM type: YTN; PAM sequence: TTT
tataaactagcagcagtctc

SEQ ID NO: 19009 - DNA, 20 bp, Artificial Sequence
  Description of Artificial Sequence: Synthetic oligonucleotide
  Target: AGXT; (+) strand; PAM type: YTN; PAM sequence: TTT
ataaactagcagcagtctcg

SEQ ID NO: 19010 - DNA, 20 bp, Artificial Sequence
  Description of Artificial Sequence: Synthetic oligonucleotide
  Target: AGXT; (+) strand; PAM type: YTN; PAM sequence: TTA
taaactagcagcagtctcgg

SEQ ID NO: 19011 - DNA, 20 bp, Artificial Sequence
  Description of Artificial Sequence: Synthetic oligonucleotide
  Target: AGXT; (+) strand; PAM type: YTN; PAM sequence: CTA
gcagcagtctcggtgactat

SEQ ID NO: 19012 - DNA, 20 bp, Artificial Sequence
  Description of Artificial Sequence: Synthetic oligonucleotide
  Target: AGXT; (+) strand; PAM type: YTN; PAM sequence: CTC
ggtgactatcccatggacac

SEQ ID NO: 19013 - DNA, 20 bp, Artificial Sequence
  Description of Artificial Sequence: Synthetic oligonucleotide
  Target: AGXT; (+) strand; PAM type: YTN; PAM sequence: CTA
tcccatggacacgagatgaa

SEQ ID NO: 19014 - DNA, 20 bp, Artificial Sequence
  Description of Artificial Sequence: Synthetic oligonucleotide
  Target: AGXT; (+) strand; PAM type: YTN; PAM sequence: CTT
cgtcattgtcaggtgtgagc

SEQ ID NO: 19015 - DNA, 20 bp, Artificial Sequence
  Description of Artificial Sequence: Synthetic oligonucleotide
  Target: AGXT; (+) strand; PAM type: YTN; PAM sequence: TTC
gtcattgtcaggtgtgagct

SEQ ID NO: 19016 - DNA, 20 bp, Artificial Sequence
  Description of Artificial Sequence: Synthetic oligonucleotide
  Target: AGXT; (+) strand; PAM type: YTN; PAM sequence: TTG
tcaggtgtgagcttctacag

SEQ ID NO: 19017 - DNA, 20 bp, Artificial Sequence
  Description of Artificial Sequence: Synthetic oligonucleotide
  Target: AGXT; (+) strand; PAM type: YTN; PAM sequence: CTT
ctacagatcctcaggtccgc

SEQ ID NO: 19018 - DNA, 20 bp, Artificial Sequence
  Description of Artificial Sequence: Synthetic oligonucleotide
  Target: AGXT; (+) strand; PAM type: YTN; PAM sequence: TTC
tacagatcctcaggtccgcc

SEQ ID NO: 19019 - DNA, 20 bp, Artificial Sequence
  Description of Artificial Sequence: Synthetic oligonucleotide
  Target: AGXT; (+) strand; PAM type: YTN; PAM sequence: CTA
cagatcctcaggtccgcctg

SEQ ID NO: 19020 - DNA, 20 bp, Artificial Sequence
  Description of Artificial Sequence: Synthetic oligonucleotide
  Target: AGXT; (+) strand; PAM type: YTN; PAM sequence: CTC
aggtccgcctggatgacagc

SEQ ID NO: 19021 - DNA, 20 bp, Artificial Sequence
  Description of Artificial Sequence: Synthetic oligonucleotide
  Target: AGXT; (+) strand; PAM type: YTN; PAM sequence: CTG
gatgacagcattgttcaagt

SEQ ID NO: 19022 - DNA, 20 bp, Artificial Sequence
  Description of Artificial Sequence: Synthetic oligonucleotide
  Target: AGXT; (+) strand; PAM type: YTN; PAM sequence: TTG
ttcaagtcttctttgtatca

SEQ ID NO: 19023 - DNA, 20 bp, Artificial Sequence
  Description of Artificial Sequence: Synthetic oligonucleotide
  Target: AGXT; (+) strand; PAM type: YTN; PAM sequence: TTC
aagtcttctttgtatcactg

SEQ ID NO: 19024 - DNA, 20 bp, Artificial Sequence
  Description of Artificial Sequence: Synthetic oligonucleotide
  Target: AGXT; (+) strand; PAM type: YTN; PAM sequence: CTT
ctttgtatcactggggtttt

SEQ ID NO: 19025 - DNA, 20 bp, Artificial Sequence
  Description of Artificial Sequence: Synthetic oligonucleotide
  Target: AGXT; (+) strand; PAM type: YTN; PAM sequence: TTC
tttgtatcactggggttttg

SEQ ID NO: 19026 - DNA, 20 bp, Artificial Sequence
  Description of Artificial Sequence: Synthetic oligonucleotide
  Target: AGXT; (+) strand; PAM type: YTN; PAM sequence: CTT
tgtatcactggggttttgtt

SEQ ID NO: 19027 - DNA, 20 bp, Artificial Sequence
  Description of Artificial Sequence: Synthetic oligonucleotide
  Target: AGXT; (+) strand; PAM type: YTN; PAM sequence: TTT
gtatcactggggttttgttg

SEQ ID NO: 19028 - DNA, 20 bp, Artificial Sequence
  Description of Artificial Sequence: Synthetic oligonucleotide
  Target: AGXT; (+) strand; PAM type: YTN; PAM sequence: TTG
tatcactggggttttgttgt

SEQ ID NO: 19029 - DNA, 20 bp, Artificial Sequence
  Description of Artificial Sequence: Synthetic oligonucleotide
  Target: AGXT; (+) strand; PAM type: YTN; PAM sequence: CTG
gggttttgttgttgttgttt

SEQ ID NO: 19030 - DNA, 20 bp, Artificial Sequence
  Description of Artificial Sequence: Synthetic oligonucleotide
  Target: AGXT; (+) strand; PAM type: YTN; PAM sequence: TTT
tgttgttgttgtttgttttg

SEQ ID NO: 19031 - DNA, 20 bp, Artificial Sequence
  Description of Artificial Sequence: Synthetic oligonucleotide
  Target: AGXT; (+) strand; PAM type: YTN; PAM sequence: TTT
gttgttgttgtttgttttgt

SEQ ID NO: 19032 - DNA, 20 bp, Artificial Sequence
  Description of Artificial Sequence: Synthetic oligonucleotide
  Target: AGXT; (+) strand; PAM type: YTN; PAM sequence: TTG
ttgttgttgtttgttttgtt

SEQ ID NO: 19033 - DNA, 20 bp, Artificial Sequence
  Description of Artificial Sequence: Synthetic oligonucleotide
  Target: AGXT; (+) strand; PAM type: YTN; PAM sequence: TTG
ttgttgtttgttttgttttg

SEQ ID NO: 19034 - DNA, 20 bp, Artificial Sequence
  Description of Artificial Sequence: Synthetic oligonucleotide
  Target: AGXT; (+) strand; PAM type: YTN; PAM sequence: TTG
ttgtttgttttgttttggtt

SEQ ID NO: 19035 - DNA, 20 bp, Artificial Sequence
  Description of Artificial Sequence: Synthetic oligonucleotide
  Target: AGXT; (+) strand; PAM type: YTN; PAM sequence: TTG
tttgttttgttttggttttt

SEQ ID NO: 19036 - DNA, 20 bp, Artificial Sequence
  Description of Artificial Sequence: Synthetic oligonucleotide
  Target: AGXT; (+) strand; PAM type: YTN; PAM sequence: TTT
gttttgttttggttttttgc

SEQ ID NO: 19037 - DNA, 20 bp, Artificial Sequence
  Description of Artificial Sequence: Synthetic oligonucleotide
  Target: AGXT; (+) strand; PAM type: YTN; PAM sequence: TTG
ttttgttttggttttttgcc

SEQ ID NO: 19038 - DNA, 20 bp, Artificial Sequence
  Description of Artificial Sequence: Synthetic oligonucleotide
  Target: AGXT; (+) strand; PAM type: YTN; PAM sequence: TTT
tgttttggttttttgcctgc

SEQ ID NO: 19039 - DNA, 20 bp, Artificial Sequence
  Description of Artificial Sequence: Synthetic oligonucleotide
  Target: AGXT; (+) strand; PAM type: YTN; PAM sequence: TTT
gttttggttttttgcctgct

SEQ ID NO: 19040 - DNA, 20 bp, Artificial Sequence
  Description of Artificial Sequence: Synthetic oligonucleotide
  Target: AGXT; (+) strand; PAM type: YTN; PAM sequence: TTG
ttttggttttttgcctgctt

SEQ ID NO: 19041 - DNA, 20 bp, Artificial Sequence
  Description of Artificial Sequence: Synthetic oligonucleotide
  Target: AGXT; (+) strand; PAM type: YTN; PAM sequence: TTT
tggttttttgcctgcttttt

SEQ ID NO: 19042 - DNA, 20 bp, Artificial Sequence
  Description of Artificial Sequence: Synthetic oligonucleotide
  Target: AGXT; (+) strand; PAM type: YTN; PAM sequence: TTT
ggttttttgcctgctttttc

SEQ ID NO: 19043 - DNA, 20 bp, Artificial Sequence
  Description of Artificial Sequence: Synthetic oligonucleotide
  Target: AGXT; (+) strand; PAM type: YTN; PAM sequence: TTG
gttttttgcctgctttttct

SEQ ID NO: 19044 - DNA, 20 bp, Artificial Sequence
  Description of Artificial Sequence: Synthetic oligonucleotide
  Target: AGXT; (+) strand; PAM type: YTN; PAM sequence: TTT
tttgcctgctttttctatga

SEQ ID NO: 19045 - DNA, 20 bp, Artificial Sequence
  Description of Artificial Sequence: Synthetic oligonucleotide
  Target: AGXT; (+) strand; PAM type: YTN; PAM sequence: TTT
ttgcctgctttttctatgaa

SEQ ID NO: 19046 - DNA, 20 bp, Artificial Sequence
  Description of Artificial Sequence: Synthetic oligonucleotide
  Target: AGXT; (+) strand; PAM type: YTN; PAM sequence: TTT
tgcctgctttttctatgaag

SEQ ID NO: 19047 - DNA, 20 bp, Artificial Sequence
  Description of Artificial Sequence: Synthetic oligonucleotide
  Target: AGXT; (+) strand; PAM type: YTN; PAM sequence: TTT
gcctgctttttctatgaagt

SEQ ID NO: 19048 - DNA, 20 bp, Artificial Sequence
  Description of Artificial Sequence: Synthetic oligonucleotide
  Target: AGXT; (+) strand; PAM type: YTN; PAM sequence: TTG
cctgctttttctatgaagta

SEQ ID NO: 19049 - DNA, 20 bp, Artificial Sequence
  Description of Artificial Sequence: Synthetic oligonucleotide
  Target: AGXT; (+) strand; PAM type: YTN; PAM sequence: CTG
ctttttctatgaagtactga

SEQ ID NO: 19050 - DNA, 20 bp, Artificial Sequence
  Description of Artificial Sequence: Synthetic oligonucleotide
  Target: AGXT; (+) strand; PAM type: YTN; PAM sequence: CTT
tttctatgaagtactgagag

SEQ ID NO: 19051 - DNA, 20 bp, Artificial Sequence
  Description of Artificial Sequence: Synthetic oligonucleotide
  Target: AGXT; (+) strand; PAM type: YTN; PAM sequence: TTT
ttctatgaagtactgagagt

SEQ ID NO: 19052 - DNA, 20 bp, Artificial Sequence
  Description of Artificial Sequence: Synthetic oligonucleotide
  Target: AGXT; (+) strand; PAM type: YTN; PAM sequence: TTT
tctatgaagtactgagagtg

SEQ ID NO: 19053 - DNA, 20 bp, Artificial Sequence
  Description of Artificial Sequence: Synthetic oligonucleotide
  Target: AGXT; (+) strand; PAM type: YTN; PAM sequence: TTT
ctatgaagtactgagagtgg

SEQ ID NO: 19054 - DNA, 20 bp, Artificial Sequence
  Description of Artificial Sequence: Synthetic oligonucleotide
  Target: AGXT; (+) strand; PAM type: YTN; PAM sequence: TTC
tatgaagtactgagagtggg

SEQ ID NO: 19055 - DNA, 20 bp, Artificial Sequence
  Description of Artificial Sequence: Synthetic oligonucleotide
  Target: AGXT; (+) strand; PAM type: YTN; PAM sequence: CTA
tgaagtactgagagtggggt

SEQ ID NO: 19056 - DNA, 20 bp, Artificial Sequence
  Description of Artificial Sequence: Synthetic oligonucleotide
  Target: AGXT; (+) strand; PAM type: YTN; PAM sequence: CTG
agagtggggtgttcagttct

SEQ ID NO: 19057 - DNA, 20 bp, Artificial Sequence
  Description of Artificial Sequence: Synthetic oligonucleotide
  Target: AGXT; (+) strand; PAM type: YTN; PAM sequence: TTC
agttctcccagcatgaatgt

SEQ ID NO: 19058 - DNA, 20 bp, Artificial Sequence
  Description of Artificial Sequence: Synthetic oligonucleotide
  Target: AGXT; (+) strand; PAM type: YTN; PAM sequence: TTC
tcccagcatgaatgtggtct

SEQ ID NO: 19059 - DNA, 20 bp, Artificial Sequence
  Description of Artificial Sequence: Synthetic oligonucleotide
  Target: AGXT; (+) strand; PAM type: YTN; PAM sequence: CTC
ccagcatgaatgtggtcttg

SEQ ID NO: 19060 - DNA, 20 bp, Artificial Sequence
  Description of Artificial Sequence: Synthetic oligonucleotide
  Target: AGXT; (+) strand; PAM type: YTN; PAM sequence: CTT
gtctccttctccctttatgc

SEQ ID NO: 19061 - DNA, 20 bp, Artificial Sequence
  Description of Artificial Sequence: Synthetic oligonucleotide
  Target: AGXT; (+) strand; PAM type: YTN; PAM sequence: TTG
tctccttctccctttatgca

SEQ ID NO: 19062 - DNA, 20 bp, Artificial Sequence
  Description of Artificial Sequence: Synthetic oligonucleotide
  Target: AGXT; (+) strand; PAM type: YTN; PAM sequence: CTC
cttctccctttatgcattca

SEQ ID NO: 19063 - DNA, 20 bp, Artificial Sequence
  Description of Artificial Sequence: Synthetic oligonucleotide
  Target: AGXT; (+) strand; PAM type: YTN; PAM sequence: CTT
ctccctttatgcattcatct

SEQ ID NO: 19064 - DNA, 20 bp, Artificial Sequence
  Description of Artificial Sequence: Synthetic oligonucleotide
  Target: AGXT; (+) strand; PAM type: YTN; PAM sequence: TTC
tccctttatgcattcatctt

SEQ ID NO: 19065 - DNA, 20 bp, Artificial Sequence
  Description of Artificial Sequence: Synthetic oligonucleotide
  Target: AGXT; (+) strand; PAM type: YTN; PAM sequence: CTC
cctttatgcattcatcttca

SEQ ID NO: 19066 - DNA, 20 bp, Artificial Sequence
  Description of Artificial Sequence: Synthetic oligonucleotide
  Target: AGXT; (+) strand; PAM type: YTN; PAM sequence: CTT
tatgcattcatcttcatgat

SEQ ID NO: 19067 - DNA, 20 bp, Artificial Sequence
  Description of Artificial Sequence: Synthetic oligonucleotide
  Target: AGXT; (+) strand; PAM type: YTN; PAM sequence: TTT
atgcattcatcttcatgatt

SEQ ID NO: 19068 - DNA, 20 bp, Artificial Sequence
  Description of Artificial Sequence: Synthetic oligonucleotide
  Target: AGXT; (+) strand; PAM type: YTN; PAM sequence: TTA
tgcattcatcttcatgattt

SEQ ID NO: 19069 - DNA, 20 bp, Artificial Sequence
  Description of Artificial Sequence: Synthetic oligonucleotide
  Target: AGXT; (+) strand; PAM type: YTN; PAM sequence: TTC
atcttcatgattttgaaggt

SEQ ID NO: 19070 - DNA, 20 bp, Artificial Sequence
  Description of Artificial Sequence: Synthetic oligonucleotide
  Target: AGXT; (+) strand; PAM type: YTN; PAM sequence: CTT
catgattttgaaggtctgtt

SEQ ID NO: 19071 - DNA, 20 bp, Artificial Sequence
  Description of Artificial Sequence: Synthetic oligonucleotide
  Target: AGXT; (+) strand; PAM type: YTN; PAM sequence: TTC
atgattttgaaggtctgttg

SEQ ID NO: 19072 - DNA, 20 bp, Artificial Sequence
  Description of Artificial Sequence: Synthetic oligonucleotide
  Target: AGXT; (+) strand; PAM type: YTN; PAM sequence: TTT
tgaaggtctgttgttaggat

SEQ ID NO: 19073 - DNA, 20 bp, Artificial Sequence
  Description of Artificial Sequence: Synthetic oligonucleotide
  Target: AGXT; (+) strand; PAM type: YTN; PAM sequence: TTT
gaaggtctgttgttaggatt

SEQ ID NO: 19074 - DNA, 20 bp, Artificial Sequence
  Description of Artificial Sequence: Synthetic oligonucleotide
  Target: AGXT; (+) strand; PAM type: YTN; PAM sequence: TTG
aaggtctgttgttaggattg

SEQ ID NO: 19075 - DNA, 20 bp, Artificial Sequence
  Description of Artificial Sequence: Synthetic oligonucleotide
  Target: AGXT; (+) strand; PAM type: YTN; PAM sequence: CTG
ttgttaggattgttacacct

SEQ ID NO: 19076 - DNA, 20 bp, Artificial Sequence
  Description of Artificial Sequence: Synthetic oligonucleotide
  Target: AGXT; (+) strand; PAM type: YTN; PAM sequence: TTG
ttaggattgttacaccttct

SEQ ID NO: 19077 - DNA, 20 bp, Artificial Sequence
  Description of Artificial Sequence: Synthetic oligonucleotide
  Target: AGXT; (+) strand; PAM type: YTN; PAM sequence: TTA
ggattgttacaccttcttga

SEQ ID NO: 19078 - DNA, 20 bp, Artificial Sequence
  Description of Artificial Sequence: Synthetic oligonucleotide
  Target: AGXT; (+) strand; PAM type: YTN; PAM sequence: TTG
ttacaccttcttgatgaact

SEQ ID NO: 19079 - DNA, 20 bp, Artificial Sequence
  Description of Artificial Sequence: Synthetic oligonucleotide
  Target: AGXT; (+) strand; PAM type: YTN; PAM sequence: TTA
caccttcttgatgaactgac

SEQ ID NO: 19080 - DNA, 20 bp, Artificial Sequence
  Description of Artificial Sequence: Synthetic oligonucleotide
  Target: AGXT; (+) strand; PAM type: YTN; PAM sequence: CTT
cttgatgaactgactatttt

SEQ ID NO: 19081 - DNA, 20 bp, Artificial Sequence
  Description of Artificial Sequence: Synthetic oligonucleotide
  Target: AGXT; (+) strand; PAM type: YTN; PAM sequence: TTC
ttgatgaactgactattttt

SEQ ID NO: 19082 - DNA, 20 bp, Artificial Sequence
  Description of Artificial Sequence: Synthetic oligonucleotide
  Target: AGXT; (+) strand; PAM type: YTN; PAM sequence: CTT
gatgaactgactatttttat

SEQ ID NO: 19083 - DNA, 20 bp, Artificial Sequence
  Description of Artificial Sequence: Synthetic oligonucleotide
  Target: AGXT; (+) strand; PAM type: YTN; PAM sequence: TTG
atgaactgactatttttatc

SEQ ID NO: 19084 - DNA, 20 bp, Artificial Sequence
  Description of Artificial Sequence: Synthetic oligonucleotide
  Target: AGXT; (+) strand; PAM type: YTN; PAM sequence: CTG
actatttttatcattgtgaa

SEQ ID NO: 19085 - DNA, 20 bp, Artificial Sequence
  Description of Artificial Sequence: Synthetic oligonucleotide
  Target: AGXT; (+) strand; PAM type: YTN; PAM sequence: CTA
tttttatcattgtgaaatat

SEQ ID NO: 19086 - DNA, 20 bp, Artificial Sequence
  Description of Artificial Sequence: Synthetic oligonucleotide
  Target: AGXT; (+) strand; PAM type: YTN; PAM sequence: TTT
ttatcattgtgaaatatcgc

SEQ ID NO: 19087 - DNA, 20 bp, Artificial Sequence
  Description of Artificial Sequence: Synthetic oligonucleotide
  Target: AGXT; (+) strand; PAM type: YTN; PAM sequence: TTT
tatcattgtgaaatatcgcc

SEQ ID NO: 19088 - DNA, 20 bp, Artificial Sequence
  Description of Artificial Sequence: Synthetic oligonucleotide
  Target: AGXT; (+) strand; PAM type: YTN; PAM sequence: TTT
atcattgtgaaatatcgccc

SEQ ID NO: 19089 - DNA, 20 bp, Artificial Sequence
  Description of Artificial Sequence: Synthetic oligonucleotide
  Target: AGXT; (+) strand; PAM type: YTN; PAM sequence: TTA
tcattgtgaaatatcgcccc

SEQ ID NO: 19090 - DNA, 20 bp, Artificial Sequence
  Description of Artificial Sequence: Synthetic oligonucleotide
  Target: AGXT; (+) strand; PAM type: YTN; PAM sequence: TTG
tgaaatatcgccccttacct

SEQ ID NO: 19091 - DNA, 20 bp, Artificial Sequence
  Description of Artificial Sequence: Synthetic oligonucleotide
  Target: AGXT; (+) strand; PAM type: YTN; PAM sequence: CTT
acctctggtaatactctttg

SEQ ID NO: 19092 - DNA, 20 bp, Artificial Sequence
  Description of Artificial Sequence: Synthetic oligonucleotide
  Target: AGXT; (+) strand; PAM type: YTN; PAM sequence: TTA
cctctggtaatactctttgt

SEQ ID NO: 19093 - DNA, 20 bp, Artificial Sequence
  Description of Artificial Sequence: Synthetic oligonucleotide
  Target: AGXT; (+) strand; PAM type: YTN; PAM sequence: CTC
tggtaatactctttgtctta

SEQ ID NO: 19094 - DNA, 20 bp, Artificial Sequence
  Description of Artificial Sequence: Synthetic oligonucleotide
  Target: AGXT; (+) strand; PAM type: YTN; PAM sequence: CTG
gtaatactctttgtcttaat

SEQ ID NO: 19095 - DNA, 20 bp, Artificial Sequence
  Description of Artificial Sequence: Synthetic oligonucleotide
  Target: AGXT; (+) strand; PAM type: YTN; PAM sequence: CTC
tttgtcttaatgtttgtgtg

SEQ ID NO: 19096 - DNA, 20 bp, Artificial Sequence
  Description of Artificial Sequence: Synthetic oligonucleotide
  Target: AGXT; (+) strand; PAM type: YTN; PAM sequence: CTT
tgtcttaatgtttgtgtgtt

SEQ ID NO: 19097 - DNA, 20 bp, Artificial Sequence
  Description of Artificial Sequence: Synthetic oligonucleotide
  Target: AGXT; (+) strand; PAM type: YTN; PAM sequence: TTT
gtcttaatgtttgtgtgttt

SEQ ID NO: 19098 - DNA, 20 bp, Artificial Sequence
  Description of Artificial Sequence: Synthetic oligonucleotide
  Target: AGXT; (+) strand; PAM type: YTN; PAM sequence: TTG
tcttaatgtttgtgtgtttt

SEQ ID NO: 19099 - DNA, 20 bp, Artificial Sequence
  Description of Artificial Sequence: Synthetic oligonucleotide
  Target: AGXT; (+) strand; PAM type: YTN; PAM sequence: CTT
aatgtttgtgtgttttcttt

SEQ ID NO: 19100 - DNA, 20 bp, Artificial Sequence
  Description of Artificial Sequence: Synthetic oligonucleotide
  Target: AGXT; (+) strand; PAM type: YTN; PAM sequence: TTA
atgtttgtgtgttttctttc

SEQ ID NO: 19101 - DNA, 20 bp, Artificial Sequence
  Description of Artificial Sequence: Synthetic oligonucleotide
  Target: AGXT; (+) strand; PAM type: YTN; PAM sequence: TTT
gtgtgttttctttccttggg

SEQ ID NO: 19102 - DNA, 20 bp, Artificial Sequence
  Description of Artificial Sequence: Synthetic oligonucleotide
  Target: AGXT; (+) strand; PAM type: YTN; PAM sequence: TTG
tgtgttttctttccttgggc

SEQ ID NO: 19103 - DNA, 20 bp, Artificial Sequence
  Description of Artificial Sequence: Synthetic oligonucleotide
  Target: AGXT; (+) strand; PAM type: YTN; PAM sequence: TTT
tctttccttgggccacttgt

SEQ ID NO: 19104 - DNA, 20 bp, Artificial Sequence
  Description of Artificial Sequence: Synthetic oligonucleotide
  Target: AGXT; (+) strand; PAM type: YTN; PAM sequence: TTT
ctttccttgggccacttgtc

SEQ ID NO: 19105 - DNA, 20 bp, Artificial Sequence
  Description of Artificial Sequence: Synthetic oligonucleotide
  Target: AGXT; (+) strand; PAM type: YTN; PAM sequence: TTC
tttccttgggccacttgtct

SEQ ID NO: 19106 - DNA, 20 bp, Artificial Sequence
  Description of Artificial Sequence: Synthetic oligonucleotide
  Target: AGXT; (+) strand; PAM type: YTN; PAM sequence: CTT
tccttgggccacttgtctct

SEQ ID NO: 19107 - DNA, 20 bp, Artificial Sequence
  Description of Artificial Sequence: Synthetic oligonucleotide
  Target: AGXT; (+) strand; PAM type: YTN; PAM sequence: TTT
ccttgggccacttgtctctc

SEQ ID NO: 19108 - DNA, 20 bp, Artificial Sequence
  Description of Artificial Sequence: Synthetic oligonucleotide
  Target: AGXT; (+) strand; PAM type: YTN; PAM sequence: TTC
cttgggccacttgtctctcc

SEQ ID NO: 19109 - DNA, 20 bp, Artificial Sequence
  Description of Artificial Sequence: Synthetic oligonucleotide
  Target: AGXT; (+) strand; PAM type: YTN; PAM sequence: CTT
gggccacttgtctctccata

SEQ ID NO: 19110 - DNA, 20 bp, Artificial Sequence
  Description of Artificial Sequence: Synthetic oligonucleotide
  Target: AGXT; (+) strand; PAM type: YTN; PAM sequence: TTG
ggccacttgtctctccatac

SEQ ID NO: 19111 - DNA, 20 bp, Artificial Sequence
  Description of Artificial Sequence: Synthetic oligonucleotide
  Target: AGXT; (+) strand; PAM type: YTN; PAM sequence: CTT
gtctctccatacaaaagaga

SEQ ID NO: 19112 - DNA, 20 bp, Artificial Sequence
  Description of Artificial Sequence: Synthetic oligonucleotide
  Target: AGXT; (+) strand; PAM type: YTN; PAM sequence: TTG
tctctccatacaaaagagat

SEQ ID NO: 19113 - DNA, 20 bp, Artificial Sequence
  Description of Artificial Sequence: Synthetic oligonucleotide
  Target: AGXT; (+) strand; PAM type: YTN; PAM sequence: CTC
tccatacaaaagagatgaac

SEQ ID NO: 19114 - DNA, 20 bp, Artificial Sequence
  Description of Artificial Sequence: Synthetic oligonucleotide
  Target: AGXT; (+) strand; PAM type: YTN; PAM sequence: CTC
catacaaaagagatgaacga

SEQ ID NO: 19115 - DNA, 20 bp, Artificial Sequence
  Description of Artificial Sequence: Synthetic oligonucleotide
  Target: AGXT; (+) strand; PAM type: YTN; PAM sequence: TTT
ctatttcttttcttttcttt

SEQ ID NO: 19116 - DNA, 20 bp, Artificial Sequence
  Description of Artificial Sequence: Synthetic oligonucleotide
  Target: AGXT; (+) strand; PAM type: YTN; PAM sequence: TTC
tatttcttttcttttctttt

SEQ ID NO: 19117 - DNA, 20 bp, Artificial Sequence
  Description of Artificial Sequence: Synthetic oligonucleotide
  Target: AGXT; (+) strand; PAM type: YTN; PAM sequence: CTA
tttcttttcttttcttttct

SEQ ID NO: 19118 - DNA, 20 bp, Artificial Sequence
  Description of Artificial Sequence: Synthetic oligonucleotide
  Target: AGXT; (+) strand; PAM type: YTN; PAM sequence: TTT
cttttcttttcttttctttt

SEQ ID NO: 19119 - DNA, 20 bp, Artificial Sequence
  Description of Artificial Sequence: Synthetic oligonucleotide
  Target: AGXT; (+) strand; PAM type: YTN; PAM sequence: TTC
ttttcttttcttttcttttc

SEQ ID NO: 19120 - DNA, 20 bp, Artificial Sequence
  Description of Artificial Sequence: Synthetic oligonucleotide
  Target: AGXT; (+) strand; PAM type: YTN; PAM sequence: CTT
ttcttttcttttcttttctt

SEQ ID NO: 19121 - DNA, 20 bp, Artificial Sequence
  Description of Artificial Sequence: Synthetic oligonucleotide
  Target: AGXT; (+) strand; PAM type: YTN; PAM sequence: TTT
tcttttcttttcttttcttt

SEQ ID NO: 19122 - DNA, 20 bp, Artificial Sequence
  Description of Artificial Sequence: Synthetic oligonucleotide
  Target: AGXT; (+) strand; PAM type: YTN; PAM sequence: TTT
cttttcttttcttttctttt

SEQ ID NO: 19123 - DNA, 20 bp, Artificial Sequence
  Description of Artificial Sequence: Synthetic oligonucleotide
  Target: AGXT; (+) strand; PAM type: YTN; PAM sequence: TTC
ttttcttttcttttcttttc

SEQ ID NO: 19124 - DNA, 20 bp, Artificial Sequence
  Description of Artificial Sequence: Synthetic oligonucleotide
  Target: AGXT; (+) strand; PAM type: YTN; PAM sequence: CTT
ttcttttcttttcttttctt

SEQ ID NO: 19125 - DNA, 20 bp, Artificial Sequence
  Description of Artificial Sequence: Synthetic oligonucleotide
  Target: AGXT; (+) strand; PAM type: YTN; PAM sequence: TTT
tcttttcttttcttttcttt

SEQ ID NO: 19126 - DNA, 20 bp, Artificial Sequence
  Description of Artificial Sequence: Synthetic oligonucleotide
  Target: AGXT; (+) strand; PAM type: YTN; PAM sequence: TTT
cttttcttttcttttctttt

SEQ ID NO: 19127 - DNA, 20 bp, Artificial Sequence
  Description of Artificial Sequence: Synthetic oligonucleotide
  Target: AGXT; (+) strand; PAM type: YTN; PAM sequence: TTC
ttttcttttcttttcttttt

SEQ ID NO: 19128 - DNA, 20 bp, Artificial Sequence
  Description of Artificial Sequence: Synthetic oligonucleotide
  Target: AGXT; (+) strand; PAM type: YTN; PAM sequence: CTT
ttcttttcttttcttttttt

SEQ ID NO: 19129 - DNA, 20 bp, Artificial Sequence
  Description of Artificial Sequence: Synthetic oligonucleotide
  Target: AGXT; (+) strand; PAM type: YTN; PAM sequence: TTT
tcttttcttttctttttttg

SEQ ID NO: 19130 - DNA, 20 bp, Artificial Sequence
  Description of Artificial Sequence: Synthetic oligonucleotide
  Target: AGXT; (+) strand; PAM type: YTN; PAM sequence: TTT
cttttcttttctttttttga

SEQ ID NO: 19131 - DNA, 20 bp, Artificial Sequence
  Description of Artificial Sequence: Synthetic oligonucleotide
  Target: AGXT; (+) strand; PAM type: YTN; PAM sequence: TTC
ttttcttttctttttttgag

SEQ ID NO: 19132 - DNA, 20 bp, Artificial Sequence
  Description of Artificial Sequence: Synthetic oligonucleotide
  Target: AGXT; (+) strand; PAM type: YTN; PAM sequence: CTT
ttcttttctttttttgagac

SEQ ID NO: 19133 - DNA, 20 bp, Artificial Sequence
  Description of Artificial Sequence: Synthetic oligonucleotide
  Target: AGXT; (+) strand; PAM type: YTN; PAM sequence: TTT
tcttttctttttttgagacg

SEQ ID NO: 19134 - DNA, 20 bp, Artificial Sequence
  Description of Artificial Sequence: Synthetic oligonucleotide
  Target: AGXT; (+) strand; PAM type: YTN; PAM sequence: TTT
cttttctttttttgagacgg

SEQ ID NO: 19135 - DNA, 20 bp, Artificial Sequence
  Description of Artificial Sequence: Synthetic oligonucleotide
  Target: AGXT; (+) strand; PAM type: YTN; PAM sequence: TTC
ttttctttttttgagacgga

SEQ ID NO: 19136 - DNA, 20 bp, Artificial Sequence
  Description of Artificial Sequence: Synthetic oligonucleotide
  Target: AGXT; (+) strand; PAM type: YTN; PAM sequence: CTT
ttctttttttgagacggagt

SEQ ID NO: 19137 - DNA, 20 bp, Artificial Sequence
  Description of Artificial Sequence: Synthetic oligonucleotide
  Target: AGXT; (+) strand; PAM type: YTN; PAM sequence: TTT
tctttttttgagacggagtt

SEQ ID NO: 19138 - DNA, 20 bp, Artificial Sequence
  Description of Artificial Sequence: Synthetic oligonucleotide
  Target: AGXT; (+) strand; PAM type: YTN; PAM sequence: TTT
ctttttttgagacggagttt

SEQ ID NO: 19139 - DNA, 20 bp, Artificial Sequence
  Description of Artificial Sequence: Synthetic oligonucleotide
  Target: AGXT; (+) strand; PAM type: YTN; PAM sequence: TTC
tttttttgagacggagtttc

SEQ ID NO: 19140 - DNA, 20 bp, Artificial Sequence
  Description of Artificial Sequence: Synthetic oligonucleotide
  Target: AGXT; (+) strand; PAM type: YTN; PAM sequence: CTT
tttttgagacggagtttcgc

SEQ ID NO: 19141 - DNA, 20 bp, Artificial Sequence
  Description of Artificial Sequence: Synthetic oligonucleotide
  Target: AGXT; (+) strand; PAM type: YTN; PAM sequence: TTT
ttttgagacggagtttcgct

SEQ ID NO: 19142 - DNA, 20 bp, Artificial Sequence
  Description of Artificial Sequence: Synthetic oligonucleotide
  Target: AGXT; (+) strand; PAM type: YTN; PAM sequence: TTT
tttgagacggagtttcgctc

SEQ ID NO: 19143 - DNA, 20 bp, Artificial Sequence
  Description of Artificial Sequence: Synthetic oligonucleotide
  Target: AGXT; (+) strand; PAM type: YTN; PAM sequence: TTT
ttgagacggagtttcgctct

SEQ ID NO: 19144 - DNA, 20 bp, Artificial Sequence
  Description of Artificial Sequence: Synthetic oligonucleotide
  Target: AGXT; (+) strand; PAM type: YTN; PAM sequence: TTT
tgagacggagtttcgctctt

SEQ ID NO: 19145 - DNA, 20 bp, Artificial Sequence
  Description of Artificial Sequence: Synthetic oligonucleotide
  Target: AGXT; (+) strand; PAM type: YTN; PAM sequence: TTT
gagacggagtttcgctcttg

SEQ ID NO: 19146 - DNA, 20 bp, Artificial Sequence
  Description of Artificial Sequence: Synthetic oligonucleotide
  Target: AGXT; (+) strand; PAM type: YTN; PAM sequence: TTG
agacggagtttcgctcttgt

SEQ ID NO: 19147 - DNA, 20 bp, Artificial Sequence
  Description of Artificial Sequence: Synthetic oligonucleotide
  Target: AGXT; (+) strand; PAM type: YTN; PAM sequence: TTT
cgctcttgttgcccaggctg

SEQ ID NO: 19148 - DNA, 20 bp, Artificial Sequence
  Description of Artificial Sequence: Synthetic oligonucleotide
  Target: AGXT; (+) strand; PAM type: YTN; PAM sequence: TTC
gctcttgttgcccaggctgg

SEQ ID NO: 19149 - DNA, 20 bp, Artificial Sequence
  Description of Artificial Sequence: Synthetic oligonucleotide
  Target: AGXT; (+) strand; PAM type: YTN; PAM sequence: CTC
ttgttgcccaggctggagtg

SEQ ID NO: 19150 - DNA, 20 bp, Artificial Sequence
  Description of Artificial Sequence: Synthetic oligonucleotide
  Target: AGXT; (+) strand; PAM type: YTN; PAM sequence: CTT
gttgcccaggctggagtgca

SEQ ID NO: 19151 - DNA, 20 bp, Artificial Sequence
  Description of Artificial Sequence: Synthetic oligonucleotide
  Target: AGXT; (+) strand; PAM type: YTN; PAM sequence: TTG
ttgcccaggctggagtgcaa

SEQ ID NO: 19152 - DNA, 20 bp, Artificial Sequence
  Description of Artificial Sequence: Synthetic oligonucleotide
  Target: AGXT; (+) strand; PAM type: YTN; PAM sequence: TTG
cccaggctggagtgcaatgg

SEQ ID NO: 19153 - DNA, 20 bp, Artificial Sequence
  Description of Artificial Sequence: Synthetic oligonucleotide
  Target: AGXT; (+) strand; PAM type: YTN; PAM sequence: CTG
gagtgcaatggtgggatctc

SEQ ID NO: 19154 - DNA, 20 bp, Artificial Sequence
  Description of Artificial Sequence: Synthetic oligonucleotide
  Target: AGXT; (+) strand; PAM type: YTN; PAM sequence: CTC
ggcttaccgcaacctccacc

SEQ ID NO: 19155 - DNA, 20 bp, Artificial Sequence
  Description of Artificial Sequence: Synthetic oligonucleotide
  Target: AGXT; (+) strand; PAM type: YTN; PAM sequence: CTT
accgcaacctccacctccca

SEQ ID NO: 19156 - DNA, 20 bp, Artificial Sequence
  Description of Artificial Sequence: Synthetic oligonucleotide
  Target: AGXT; (+) strand; PAM type: YTN; PAM sequence: TTA
ccgcaacctccacctcccag

SEQ ID NO: 19157 - DNA, 20 bp, Artificial Sequence
  Description of Artificial Sequence: Synthetic oligonucleotide
  Target: AGXT; (+) strand; PAM type: YTN; PAM sequence: CTC
cacctcccaggttcaagcaa

SEQ ID NO: 19158 - DNA, 20 bp, Artificial Sequence
  Description of Artificial Sequence: Synthetic oligonucleotide
  Target: AGXT; (+) strand; PAM type: YTN; PAM sequence: CTC
ccaggttcaagcaattctcc

SEQ ID NO: 19159 - DNA, 20 bp, Artificial Sequence
  Description of Artificial Sequence: Synthetic oligonucleotide
  Target: AGXT; (+) strand; PAM type: YTN; PAM sequence: TTC
aagcaattctcctgcctcag

SEQ ID NO: 19160 - DNA, 20 bp, Artificial Sequence
  Description of Artificial Sequence: Synthetic oligonucleotide
  Target: AGXT; (+) strand; PAM type: YTN; PAM sequence: TTC
tcctgcctcagcctcccgag

SEQ ID NO: 19161 - DNA, 20 bp, Artificial Sequence
  Description of Artificial Sequence: Synthetic oligonucleotide
  Target: AGXT; (+) strand; PAM type: YTN; PAM sequence: CTC
ctgcctcagcctcccgagta

SEQ ID NO: 19162 - DNA, 20 bp, Artificial Sequence
  Description of Artificial Sequence: Synthetic oligonucleotide
  Target: AGXT; (+) strand; PAM type: YTN; PAM sequence: CTG
cctcagcctcccgagtagct

SEQ ID NO: 19163 - DNA, 20 bp, Artificial Sequence
  Description of Artificial Sequence: Synthetic oligonucleotide
  Target: AGXT; (+) strand; PAM type: YTN; PAM sequence: CTC
agcctcccgagtagctggga

SEQ ID NO: 19164 - DNA, 20 bp, Artificial Sequence
  Description of Artificial Sequence: Synthetic oligonucleotide
  Target: AGXT; (+) strand; PAM type: YTN; PAM sequence: CTC
ccgagtagctgggattacag

SEQ ID NO: 19165 - DNA, 20 bp, Artificial Sequence
  Description of Artificial Sequence: Synthetic oligonucleotide
  Target: AGXT; (+) strand; PAM type: YTN; PAM sequence: CTG
ggattacaggcacctgccac

SEQ ID NO: 19166 - DNA, 20 bp, Artificial Sequence
  Description of Artificial Sequence: Synthetic oligonucleotide
  Target: AGXT; (+) strand; PAM type: YTN; PAM sequence: TTA
caggcacctgccaccatgcc

SEQ ID NO: 19167 - DNA, 20 bp, Artificial Sequence
  Description of Artificial Sequence: Synthetic oligonucleotide
  Target: AGXT; (+) strand; PAM type: YTN; PAM sequence: CTG
ccaccatgcccggctaattt

SEQ ID NO: 19168 - DNA, 20 bp, Artificial Sequence
  Description of Artificial Sequence: Synthetic oligonucleotide
  Target: AGXT; (+) strand; PAM type: YTN; PAM sequence: CTA
attttttgtatttttagtag

SEQ ID NO: 19169 - DNA, 20 bp, Artificial Sequence
  Description of Artificial Sequence: Synthetic oligonucleotide
  Target: AGXT; (+) strand; PAM type: YTN; PAM sequence: TTT
tttgtatttttagtagagac

SEQ ID NO: 19170 - DNA, 20 bp, Artificial Sequence
  Description of Artificial Sequence: Synthetic oligonucleotide
  Target: AGXT; (+) strand; PAM type: YTN; PAM sequence: TTT
ttgtatttttagtagagacg

SEQ ID NO: 19171 - DNA, 20 bp, Artificial Sequence
  Description of Artificial Sequence: Synthetic oligonucleotide
  Target: AGXT; (+) strand; PAM type: YTN; PAM sequence: TTT
tgtatttttagtagagacgg

SEQ ID NO: 19172 - DNA, 20 bp, Artificial Sequence
  Description of Artificial Sequence: Synthetic oligonucleotide
  Target: AGXT; (+) strand; PAM type: YTN; PAM sequence: TTT
gtatttttagtagagacggg

SEQ ID NO: 19173 - DNA, 20 bp, Artificial Sequence
  Description of Artificial Sequence: Synthetic oligonucleotide
  Target: AGXT; (+) strand; PAM type: YTN; PAM sequence: TTG
tatttttagtagagacgggg

SEQ ID NO: 19174 - DNA, 20 bp, Artificial Sequence
  Description of Artificial Sequence: Synthetic oligonucleotide
  Target: AGXT; (+) strand; PAM type: YTN; PAM sequence: TTT
ttagtagagacggggtttta

SEQ ID NO: 19175 - DNA, 20 bp, Artificial Sequence
  Description of Artificial Sequence: Synthetic oligonucleotide
  Target: AGXT; (+) strand; PAM type: YTN; PAM sequence: TTT
tagtagagacggggttttac

SEQ ID NO: 19176 - DNA, 20 bp, Artificial Sequence
  Description of Artificial Sequence: Synthetic oligonucleotide
  Target: AGXT; (+) strand; PAM type: YTN; PAM sequence: TTT
agtagagacggggttttacc

SEQ ID NO: 19177 - DNA, 20 bp, Artificial Sequence
  Description of Artificial Sequence: Synthetic oligonucleotide
  Target: AGXT; (+) strand; PAM type: YTN; PAM sequence: TTA
gtagagacggggttttacca

SEQ ID NO: 19178 - DNA, 20 bp, Artificial Sequence
  Description of Artificial Sequence: Synthetic oligonucleotide
  Target: AGXT; (+) strand; PAM type: YTN; PAM sequence: TTT
taccatgttggccaggctgg

SEQ ID NO: 19179 - DNA, 20 bp, Artificial Sequence
  Description of Artificial Sequence: Synthetic oligonucleotide
  Target: AGXT; (+) strand; PAM type: YTN; PAM sequence: TTT
accatgttggccaggctggt

SEQ ID NO: 19180 - DNA, 20 bp, Artificial Sequence
  Description of Artificial Sequence: Synthetic oligonucleotide
  Target: AGXT; (+) strand; PAM type: YTN; PAM sequence: TTA
ccatgttggccaggctggtc

SEQ ID NO: 19181 - DNA, 20 bp, Artificial Sequence
  Description of Artificial Sequence: Synthetic oligonucleotide
  Target: AGXT; (+) strand; PAM type: YTN; PAM sequence: TTG
gccaggctggtctcgaactc

SEQ ID NO: 19182 - DNA, 20 bp, Artificial Sequence
  Description of Artificial Sequence: Synthetic oligonucleotide
  Target: AGXT; (+) strand; PAM type: YTN; PAM sequence: CTG
gtctcgaactcctgacctca

SEQ ID NO: 19183 - DNA, 20 bp, Artificial Sequence
  Description of Artificial Sequence: Synthetic oligonucleotide
  Target: AGXT; (+) strand; PAM type: YTN; PAM sequence: CTC
gaactcctgacctcaggtga

SEQ ID NO: 19184 - DNA, 20 bp, Artificial Sequence
  Description of Artificial Sequence: Synthetic oligonucleotide
  Target: AGXT; (+) strand; PAM type: YTN; PAM sequence: CTC
ctgacctcaggtgatccacc

SEQ ID NO: 19185 - DNA, 20 bp, Artificial Sequence
  Description of Artificial Sequence: Synthetic oligonucleotide
  Target: AGXT; (+) strand; PAM type: YTN; PAM sequence: CTG
acctcaggtgatccacccac

SEQ ID NO: 19186 - DNA, 20 bp, Artificial Sequence
  Description of Artificial Sequence: Synthetic oligonucleotide
  Target: AGXT; (+) strand; PAM type: YTN; PAM sequence: CTC
aggtgatccacccaccccgg

SEQ ID NO: 19187 - DNA, 20 bp, Artificial Sequence
  Description of Artificial Sequence: Synthetic oligonucleotide
  Target: AGXT; (+) strand; PAM type: YTN; PAM sequence: CTC
ccaaagtgctgggattacag

SEQ ID NO: 19188 - DNA, 20 bp, Artificial Sequence
  Description of Artificial Sequence: Synthetic oligonucleotide
  Target: AGXT; (+) strand; PAM type: YTN; PAM sequence: CTG
ggattacagatgtgagccac

SEQ ID NO: 19189 - DNA, 20 bp, Artificial Sequence
  Description of Artificial Sequence: Synthetic oligonucleotide
  Target: AGXT; (+) strand; PAM type: YTN; PAM sequence: TTA
cagatgtgagccaccgcgcc

SEQ ID NO: 19190 - DNA, 20 bp, Artificial Sequence
  Description of Artificial Sequence: Synthetic oligonucleotide
  Target: AGXT; (+) strand; PAM type: YTN; PAM sequence: CTG
gcccagtttctatttcttga

SEQ ID NO: 19191 - DNA, 20 bp, Artificial Sequence
  Description of Artificial Sequence: Synthetic oligonucleotide
  Target: AGXT; (+) strand; PAM type: YTN; PAM sequence: TTT
ctatttcttgatactctgcc

SEQ ID NO: 19192 - DNA, 20 bp, Artificial Sequence
  Description of Artificial Sequence: Synthetic oligonucleotide
  Target: AGXT; (+) strand; PAM type: YTN; PAM sequence: TTC
tatttcttgatactctgccc

SEQ ID NO: 19193 - DNA, 20 bp, Artificial Sequence
  Description of Artificial Sequence: Synthetic oligonucleotide
  Target: AGXT; (+) strand; PAM type: YTN; PAM sequence: CTA
tttcttgatactctgcccat

SEQ ID NO: 19194 - DNA, 20 bp, Artificial Sequence
  Description of Artificial Sequence: Synthetic oligonucleotide
  Target: AGXT; (+) strand; PAM type: YTN; PAM sequence: TTT
cttgatactctgcccatgcg

SEQ ID NO: 19195 - DNA, 20 bp, Artificial Sequence
  Description of Artificial Sequence: Synthetic oligonucleotide
  Target: AGXT; (+) strand; PAM type: YTN; PAM sequence: TTC
ttgatactctgcccatgcgg

SEQ ID NO: 19196 - DNA, 20 bp, Artificial Sequence
  Description of Artificial Sequence: Synthetic oligonucleotide
  Target: AGXT; (+) strand; PAM type: YTN; PAM sequence: CTT
gatactctgcccatgcggag

SEQ ID NO: 19197 - DNA, 20 bp, Artificial Sequence
  Description of Artificial Sequence: Synthetic oligonucleotide
  Target: AGXT; (+) strand; PAM type: YTN; PAM sequence: TTG
atactctgcccatgcggagg

SEQ ID NO: 19198 - DNA, 20 bp, Artificial Sequence
  Description of Artificial Sequence: Synthetic oligonucleotide
  Target: AGXT; (+) strand; PAM type: YTN; PAM sequence: CTC
tgcccatgcggaggattttc

SEQ ID NO: 19199 - DNA, 20 bp, Artificial Sequence
  Description of Artificial Sequence: Synthetic oligonucleotide
  Target: AGXT; (+) strand; PAM type: YTN; PAM sequence: CTG
cccatgcggaggattttccc

SEQ ID NO: 19200 - DNA, 20 bp, Artificial Sequence
  Description of Artificial Sequence: Synthetic oligonucleotide
  Target: AGXT; (+) strand; PAM type: YTN; PAM sequence: TTT
tccctcaccactctcttcta

SEQ ID NO: 19201 - DNA, 20 bp, Artificial Sequence
  Description of Artificial Sequence: Synthetic oligonucleotide
  Target: AGXT; (+) strand; PAM type: YTN; PAM sequence: TTT
ccctcaccactctcttctag

SEQ ID NO: 19202 - DNA, 20 bp, Artificial Sequence
  Description of Artificial Sequence: Synthetic oligonucleotide
  Target: AGXT; (+) strand; PAM type: YTN; PAM sequence: TTC
cctcaccactctcttctagg

SEQ ID NO: 19203 - DNA, 20 bp, Artificial Sequence
  Description of Artificial Sequence: Synthetic oligonucleotide
  Target: AGXT; (+) strand; PAM type: YTN; PAM sequence: CTC
accactctcttctaggaacc

SEQ ID NO: 19204 - DNA, 20 bp, Artificial Sequence
  Description of Artificial Sequence: Synthetic oligonucleotide
  Target: AGXT; (+) strand; PAM type: YTN; PAM sequence: CTC
tcttctaggaaccctgagtt

SEQ ID NO: 19205 - DNA, 20 bp, Artificial Sequence
  Description of Artificial Sequence: Synthetic oligonucleotide
  Target: AGXT; (+) strand; PAM type: YTN; PAM sequence: CTC
ttctaggaaccctgagttgg

SEQ ID NO: 19206 - DNA, 20 bp, Artificial Sequence
  Description of Artificial Sequence: Synthetic oligonucleotide
  Target: AGXT; (+) strand; PAM type: YTN; PAM sequence: CTT
ctaggaaccctgagttggga

SEQ ID NO: 19207 - DNA, 20 bp, Artificial Sequence
  Description of Artificial Sequence: Synthetic oligonucleotide
  Target: AGXT; (+) strand; PAM type: YTN; PAM sequence: TTC
taggaaccctgagttgggaa

SEQ ID NO: 19208 - DNA, 20 bp, Artificial Sequence
  Description of Artificial Sequence: Synthetic oligonucleotide
  Target: AGXT; (+) strand; PAM type: YTN; PAM sequence: CTA
ggaaccctgagttgggaaag

SEQ ID NO: 19209 - DNA, 20 bp, Artificial Sequence
  Description of Artificial Sequence: Synthetic oligonucleotide
  Target: AGXT; (+) strand; PAM type: YTN; PAM sequence: CTG
agttgggaaagtccattttg

SEQ ID NO: 19210 - DNA, 20 bp, Artificial Sequence
  Description of Artificial Sequence: Synthetic oligonucleotide
  Target: AGXT; (+) strand; PAM type: YTN; PAM sequence: TTG
ggaaagtccattttggttcg

SEQ ID NO: 19211 - DNA, 20 bp, Artificial Sequence
  Description of Artificial Sequence: Synthetic oligonucleotide
  Target: AGXT; (+) strand; PAM type: YTN; PAM sequence: TTT
tggttcgcaccaaaagacca

SEQ ID NO: 19212 - DNA, 20 bp, Artificial Sequence
  Description of Artificial Sequence: Synthetic oligonucleotide
  Target: AGXT; (+) strand; PAM type: YTN; PAM sequence: TTT
ggttcgcaccaaaagaccaa

SEQ ID NO: 19213 - DNA, 20 bp, Artificial Sequence
  Description of Artificial Sequence: Synthetic oligonucleotide
  Target: AGXT; (+) strand; PAM type: YTN; PAM sequence: TTG
gttcgcaccaaaagaccaag

SEQ ID NO: 19214 - DNA, 20 bp, Artificial Sequence
  Description of Artificial Sequence: Synthetic oligonucleotide
  Target: AGXT; (+) strand; PAM type: YTN; PAM sequence: TTC
gcaccaaaagaccaagccat

SEQ ID NO: 19215-19244 - skipped (30 entries)

SEQ ID NO: 19245 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 19246 - RNA, 100 nt, Artificial Sequence
  chemically synthesized
  misc_feature (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 19247 - RNA, 96 nt, Artificial Sequence
  chemically synthesized
  misc_feature (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 19248 - RNA, 114 nt, Artificial Sequence
  chemically synthesized
  misc_feature (1)..(30): n is a, c, g, u, or other and this region may encompass 17-30 nucleotides;
  misc_feature (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 19249 - protein, 9 aa, Unknown
  Description of Unknown: Homing endonuclease sequence
LAGLIDADG
